US011806395B2

(12) United States Patent
Delecluse et al.

(10) Patent No.: US 11,806,395 B2
(45) Date of Patent: Nov. 7, 2023

(54) EPSTEIN-BARR VIRUS-LIKE PARTICLES WITH BROADENED ANTIGENIC SPECTRUM

(71) Applicant: Deutsches Krebsforschungszentrum, Heidelberg (DE)

(72) Inventors: Henri-Jacques Delecluse, Heidelberg (DE); Dwain Van Zyl, Heidelberg (DE)

(73) Assignee: Deutsches Krebsforschungszentrum, Heidelberg (DE)

( * ) Notice: Subject to any disclaimer, the term of this patent is extended or adjusted under 35 U.S.C. 154(b) by 0 days.

(21) Appl. No.: 17/284,528

(22) PCT Filed: Oct. 11, 2019

(86) PCT No.: PCT/EP2019/077605
§ 371 (c)(1),
(2) Date: Apr. 12, 2021

(87) PCT Pub. No.: WO2020/074708
PCT Pub. Date: Apr. 16, 2020

(65) Prior Publication Data
US 2021/0290758 A1 Sep. 23, 2021

(30) Foreign Application Priority Data
Oct. 12, 2018 (EP) .................... 18200051

(51) Int. Cl.
*A61K 39/245* (2006.01)
*C12N 7/00* (2006.01)
*A61K 39/00* (2006.01)

(52) U.S. Cl.
CPC .............. *A61K 39/245* (2013.01); *C12N 7/00* (2013.01); *A61K 2039/5258* (2013.01); *A61K 2039/572* (2013.01); *C12N 2710/16023* (2013.01); *C12N 2710/16034* (2013.01); *C12N 2710/16071* (2013.01)

(58) Field of Classification Search
CPC .......... A61K 39/245; A61K 2039/5258; A61K 2039/572; C12N 7/00; C12N 2710/16023; C12N 2710/16034; C12N 2710/16071
See application file for complete search history.

(56) References Cited

U.S. PATENT DOCUMENTS

| | | | | |
|---|---|---|---|---|
| 8,119,145 | B2 * | 2/2012 | Coit | A61P 31/00 435/325 |
| 9,517,261 | B2 * | 12/2016 | Feederle | A61K 39/245 |
| 10,300,129 | B2 | 5/2019 | Ruiss et al. | |
| 10,960,072 | B2 * | 3/2021 | Ogembo | A61K 39/12 |
| 11,097,003 | B2 * | 8/2021 | Delecluse | A61P 43/00 |
| 2014/0322255 | A1 * | 10/2014 | Feederle | A61P 31/22 435/69.3 |
| 2016/0296618 | A1 * | 10/2016 | Ruiss | A61K 39/12 |

FOREIGN PATENT DOCUMENTS

| | | | | |
|---|---|---|---|---|
| JP | 2013541507 | A | 11/2013 | |
| WO | 2010128338 | A2 | 11/2010 | |
| WO | WO-2010128338 | A2 * | 11/2010 | ......... A61K 39/0011 |
| WO | 2012025603 | A1 | 3/2012 | |
| WO | 2013098364 | A1 | 7/2013 | |
| WO | WO-2013186178 | A1 * | 12/2013 | ............. A61K 39/12 |
| WO | 2017148928 | A1 | 9/2017 | |
| WO | WO-2017148928 | A1 * | 9/2017 | ........... A61K 39/245 |
| WO | WO-2018087296 | A1 * | 5/2018 | ............. A61K 39/12 |

OTHER PUBLICATIONS

Abbott RJ, Quinn LL, Leese AM, Scholes HM, Pachnio A, Rickinson AB. CD8+ T cell responses to lytic EBV infection: late antigen specificities as subdominant components of the total response. J Immunol. Dec. 1, 2013;191(11):5398-409. Epub Oct. 21, 2013. (Year: 2013).*
Nardin EH, Oliveira GA, Calvo-Calle JM, Wetzel K, Maier C, Birkett AJ, Sarpotdar P, Corado ML, Thornton GB, Schmidt A. Phase I testing of a malaria vaccine composed of hepatitis B virus core particles expressing Plasmodium falciparum circumsporozoite epitopes. Infect Immun. Nov. 2004;72(11):6519-27. (Year: 2004).*
Hudson GS, et. al. RecName: Full=Major tegument protein; Short= MTP; AltName: Full=Protein p. 140. UniProtKB/Swiss-Prot: P03179. 1, First Dep. Apr. 24, 1993. (Year: 1993).*
Pavlova, Sophia et al.; An Epstein-Barr Virus Mutant Produces Immunogenic Defective Particles Devoid of Viral DNA; Journal of Virology; Feb. 2013; pp. 2011-2022; vol. 87; No. 4; American Society for Microbiology.
Ruiss, Romana et al.; A Virus-Like Particle-Based Epstein-Barr Virus Vaccine; Journal of Virology; Dec. 2011; pp. 13105-13113; vol. 85; No. 24; American Society for Microbiology.
Perez, Elizabeth M. et al.; Novel Epstein-Barr virus-like particles incorporating gH/gL-EBNA1 or gB-LMP2 induce high neutralizing antibody titers and EBV-specific T-cell responses in immunized mice; Oncotarget; 2017; pp. 19255-19273; vol. 8; No. 12.
Ogembo, Javier Gordon et al.; A chimeric EBV gp350/220-based VLP replicates the virion B-cell attachment mechanism and elicits long-lasting neutralizing antibodies in mice; Journal of Translational Medicine; 2015; 15 pages; vol. 13.
Johannsen, Eric et al.; Proteins of purified Epstein-Barr virus; PNAS; Nov. 16, 2004; pp. 16286-16291; vol. 101; No. 46; The National Academy of Sciences of the USA.

(Continued)

*Primary Examiner* — Rachel B Gill
(74) *Attorney, Agent, or Firm* — Taft Stettinius & Hollister LLP

(57) ABSTRACT

The present invention relates to a preparation comprising Epstein-Barr virus-like particles (EB-VLPs), said EB-VLPs being essentially free of Epstein Barr virus (EBV) DNA, wherein said EB-VLPs comprise a vaccination polypeptide comprising at least one peptide of an EBV tegument polypeptide and at least one immunogenic peptide; and to polynucleotides, host cells, and methods related thereto.

15 Claims, 10 Drawing Sheets

Figure 1:
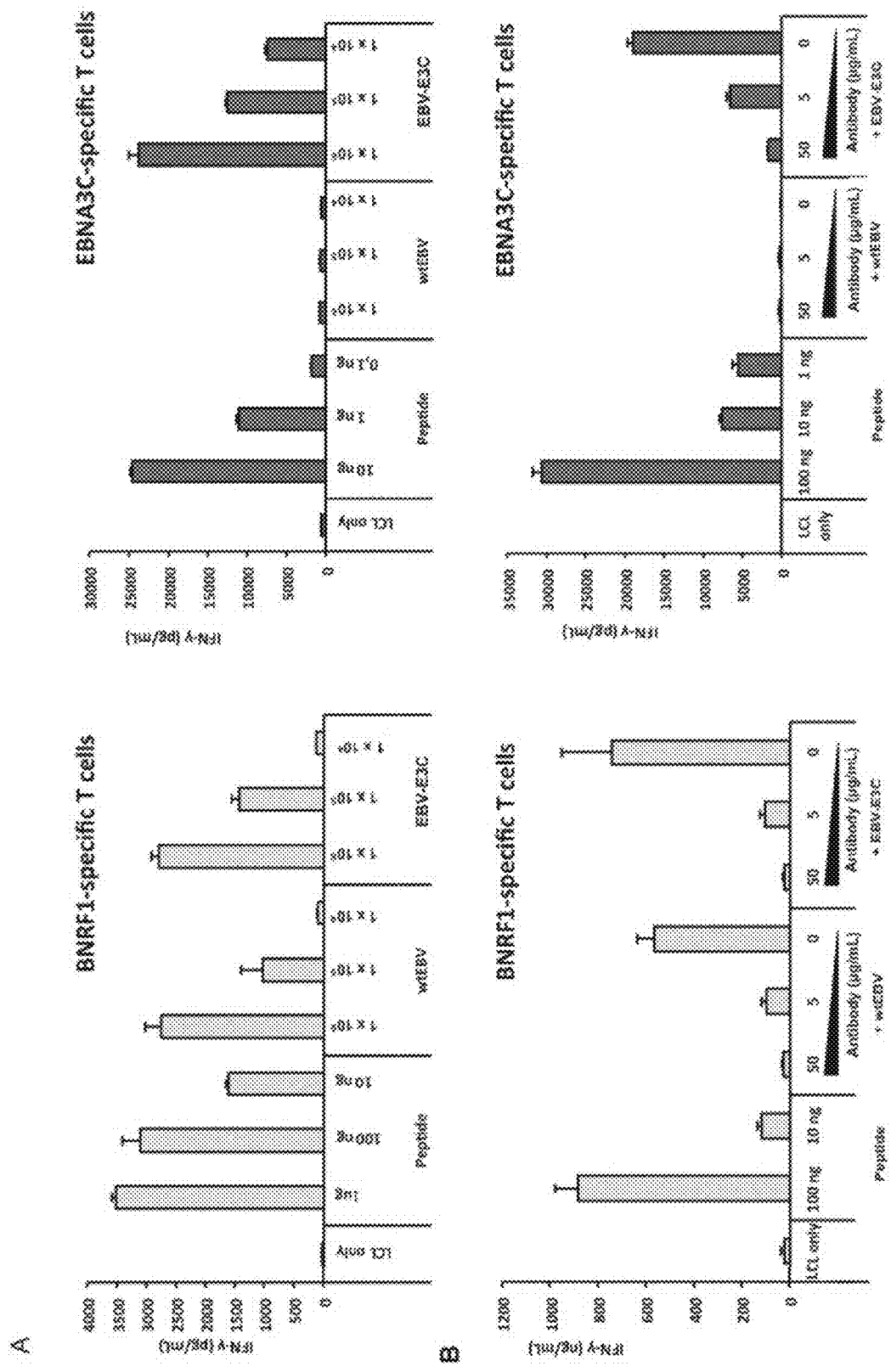

Specification includes a Sequence Listing.

(56) References Cited

OTHER PUBLICATIONS

Feederle, R. et al.; Epstein-Barr Virus BNRF1 Protein Allows Efficient Transfer from the Endosomal Compartment to the Nucleus of Primary B Lymphocytes; Journal of Virology; Oct. 2006; pp. 9435-9443; vol. 80; No. 19; American Society for Microbiology.
Van Zyl, Dwain George; Modified virus as a vaccine against EBV infection; Dissertation; 2018; 123 pages.
Adhikary, Dinesh et al.; Immunodominance of Lytic Cycle Antigens in Epstein-Barr Virus-Specific CD4+ T Cell Preparations for Therapy; PLoS One; Jul. 2007; 10 pages; vol. 2; No. 7.
Adhikary, Dinesh et al.; Standardized and Highly Efficient Expansion of Epstein-Barr Virus-Specific CD4+ T Cells by Using Virus-Like Particles; Journal of Virology; Apr. 2008; pp. 3903-3911; vol. 82; No. 8; American Society for Microbiology.
Bernardeau, K. et al.; A simple competitive assay to determine peptide affinity for HLA class II molecules: A useful tool for epitope prediction; Journal of Immunological Methods; 2011; pp. 97-105; vol. 371; Elsevier B.V.
Bordner, Andrew J.; Towards Universal Structure-Based Prediction of Class II MHC Epitopes for Diverse Allotypes; PLoS One: Dec. 2010; 12 pages; vol. 5; No. 12.
Greenstone, Heather L. et al.; Chimeric papillomavirus virus-like particles elicit antitumor immunity against the E7 oncoprotein in an HPV16 tumor model; Proc. Natl. Acad. Sci. USA; Feb. 1998; pp. 1800-1805; vol. 95; The National Academy of Sciences.
Fearon, Douglas T. et al.; Regulation of B Lymphocyte Responses to Foreign and Self-Antigens by the CD19/CD21 Complex; Annu. Rev. Immunol.; 2000; pp. 393-422; vol. 18; Annual Reviews.
Janz, Annette et al.; Infectious Epstein-Barr Virus Lacking Major Glycoprotein BLLF1 (gp350/220) Demonstrates the Existence of Additional Viral Ligands; Journal of Virology; Nov. 2000; pp. 10142-10152; vol. 74; No. 21; American Society for Microbiology.
Kieff, Elliott D. et al.; 68A: Epstein-Barr Virus and Its Replication; Fields Virology; 2006; pp. 2603-2654; 5th ed.
Rickinson, Alan B. et al.; 68B: Epstein-Barr Virus; Fields Virology; 2006; pp. 2655-2700; 5th ed.
Linnerbauer, Stefanie et al.; Virus and Autoantigen-Specific CD4+ T Cells Are Key Effectors in a SCID Mouse Model of EBV-Associated Post-Transplant Lymphoproliferative Disorders; PLOS Pathogens; May 2014; 12 pages; vol. 10; No. 5.
Küppers, Ralf; B Cells Under Influence: Transformation of B Cells by Epstein-Barr Virus; Nature Reviews; Oct. 2003; pp. 801-812; vol. 3.
Long, Heather M. et al.; Immune defence against EBV and EBV-associated disease; Current Opinion in Immunology; 2011; pp. 258-264; vol. 23; Elsevier Ltd.
Rees, Lesley et al.; A Phase I Trial of Epstein-Barr Virus Gp350 Vaccine for Children With Chronic Kidney Disease Awaiting Transplantation; Transplantation; Oct. 27, 2009; pp. 1025-1029; vol. 88; No. 8; Lippincott Williams & Wilkins.
Rooney, Cliona M. et al.; Infusion of Cytotoxic T Cells for the Prevention and Treatment of Epstein-Barr Virus-Induced Lymphoma in Allogeneic Transplant Recipients; Blood; Sep. 1, 1998; pp. 1549-1555; vol. 92; No. 5; The American Society of Hematology.
Shumilov, Anatoliy et al.; Epstein-Barr virus particles induce centrosome amplification and chromosomal instability; Nature Communications; Feb. 10, 2017; 15 pages.
Tsai, Ming-Han et al.; Spontaneous Lytic Replication and Epitheliotropism Define an Epstein-Barr Virus Strain Found in Carcinomas; Cell Reports; Oct. 31, 2013; pp. 458-470; vol. 5.
Warming, Søren et al.; Simple and highly efficient BAC recombineering using galk selection; Nucleic Acids Research; 2005; 12 pages; vol. 33; No. 4; Oxford University Press.
Yu, Xiaojun et al.; Antigen-armed antibodies targeting B lymphoma cells effectively activate antigen-specific CD4+ T cells; Blood; Mar. 5, 2015; pp. 1601-1610; vol. 125; No. 10; The American Society of Hematology.
Tarbouriech, Nicolas et al.; Structural genomics of the Epstein-Barr virus; Acta Crystallographica Section D; 2006; pp. 1276-1285; International Union of Crystallography.
De Jesus, Orlando et al.; Updated Epstein-Barr virus (EBV) DNA sequence and analysis of a promoter for the BART (CST, BARFO) RNAs of EBV; Journal of General Virology; 2003; pp. 1443-1450; vol. 84; SGM.
Dolan, Aidan et al.; The genome of Epstein-Barr virus type 2 strain AG876; Virology; 2006; pp. 164-170; vol. 350; Elsevier Inc.
Laichalk, Lauri et al.; Terminal Differentiation into Plasma Cells Initiates the Replicative Cycle of Epstein-Barr Virus In Vivo; Journal of Virology; Jan. 2005; pp. 1296-1307; vol. 79, No. 2; American Society for Microbiology.
Lin, Xiaochen et al.; The Epstein-Barr Virus BART miRNA Cluster of the M81 Strain Modulates Multiple Functions in Primary B Cells; PLOS Pathogens; Dec. 22, 2015; 30 pages; vol. 11, No. 12.
Mandic, A. et al.; Human papillomavirus vaccine as a new way of preventing cervical cancer: a dream or the future ?; Annals of Oncology; 2004; pp. 197-200; vol. 15; European Society for Medical Oncology.
Neuhierl, Bernhard et al.; Primary B-Cell Infection with a ΔBALF4 Epstein-Barr Virus Comes to a Halt in the Endosomal Compartment yet Still Elicits a Potent CD4-Positive Cytotoxic T-Cell Response; Journal of Virology; May 2009; pp. 4616-4623; vol. 83, No. 9; American Society for Microbiology.
Nielsen, Morten et al.; Improved prediction of MHC class I and class II epitopes using a novel Gibbs sampling approach; Bioinformatics; 2004; pp. 1388-1397; vol. 20, No. 9; Oxford University Press.
International Search Report; European Patent Office; International Application No. PCT/EP2019/077605; dated Jan. 21, 2020; 6 pages.
Written Opinion of the International Searching Authority; European Patent Office; International Application No. PCT/EP2019/077605; dated Jan. 21, 2020; 7 pages.
Office Action; Japanese Patent Office; Japanese Application No. 2021-519732; dated May 9, 2023; 6 pages.

\* cited by examiner

A

B

A

EPSTEIN-BARR VIRUS-LIKE PARTICLES WITH BROADENED ANTIGENIC SPECTRUM

CROSS-REFERENCE TO RELATED APPLICATIONS

This application is a U.S. National Phase of International PCT Application No. PCT/EP2019/077605 filed Oct. 11, 2019, which claims priority to European Patent Application No. 18200051.3 filed Oct. 12, 2018, the contents of each application are incorporated herein by reference in their entirety.

The present invention relates to a preparation comprising Epstein-Barr virus-like particles (EB-VLPs), said EB-VLPs being essentially free of Epstein Barr virus (EBV) DNA, wherein said EB-VLPs comprise a vaccination polypeptide comprising at least one peptide of an EBV tegument polypeptide and at least one immunogenic peptide; and to polynucleotides, host cells, and methods related thereto.

The oncogenic Epstein-Barr virus (EBV) belongs to the family of gammaherpesviruses that can infect human B lymphocytes latently. EBV establishes lifelong persistent B-cell infections in more than 90% of the human population (Kieff and B. Rickinson. (2006), Epstein-Barr virus and its replication, In D. M. Knipe and P. M. Howley (ed.), Fields virology, 5th ed. Lippincott-Raven, Philadelphia, Pa. 2603-2654; Küppers, R. (2003). B cells under influence: transformation of B cells by Epstein-Barr virus, Nat. Rev. Immunol. 3:801-812). In healthy individuals, the majority of EBV infected B cells show limited viral gene expression and a resting phenotype. The terminal differentiation of latently infected cells into plasma cells leads to virus reactivation, production, and reinfection of B cells (Laichalk, L. L., and D. A. Thorley-Lawson. (2005), Terminal differentiation into plasma cells initiates the replicative cycle of Epstein-Barr virus in vivo. J. Virol. 79:1296-1307). The expression of all viral latency genes causes growth transformation and the proliferation of infected B cells, which is reflected by the outgrowth of EBV-transformed lymphoblastoid. B-cell lines in vitro and by the association of EBV with a variety of B-cell lymphoproliferative diseases, including different types of lymphoma, in vivo. EBV infection is controlled by T cells, as indicated by an increased incidence of EBV-associated malignancies in patients with congenital or iatrogenically induced T-cell dysfunction (Rickinson, A. B., and E. Kieff (2006), Epstein-Barr virus, In D. M. Knipe and P. M. Howley (ed.), Fields virology, 5th ed. Lippincott-Raven, Philadelphia, Pa., 2655-2700) and by the successful treatment of EBV-associated posttransplant lymphoproliferative disease in hematopoietic stem cell transplant recipients by the infusion of polyclonal EBV-specific T-cell lines (Rooney, C. M., et al., (1998), Infusion of cytotoxic T cells for the prevention and treatment of Epstein-Barr virus-induced lymphoma in allogeneic transplant recipients. Blood. 92:1549-1555).

There is thus a need in the art to develop a vaccine to prevent or clear EBV infection. Such a vaccine would be applied to an apparently healthy subject, so safety of such a vaccine would be a major concern. So far, there is only a peptidic vaccine against EBV gp350 in a phase 11 clinical trial. However, first clinical trials with this vaccine show it does not prevent EBV infection in EBV-negative transplant recipients (Rees L, et al., (2009), A phase I trial of Epstein-Barr virus gp350 vaccine for children with chronic kidney disease awaiting transplantation. Transplantation 88(8): 1025-9).

Virus-like particles (VLPs) are structures similar or identical to mature virions but lack the viral genome. In general, they stimulate the host's immune response to a higher extent than e.g. monomeric peptides do, which is why they have been preferentially used for vaccination against several viruses such as hepatitis B and papillomavirus (Greenstone, H. L., et, al. (1998), Chimeric papillomavirus virus-like particles elicit antitumor immunity against the E7 oncoprotein in an HPV16 tumor model. Proc. Natl. Acad. Sci. USA 95:1800-1805; Mandic, A., and T. Vujkov, (2004). Human papillomavirus vaccine as a new way of preventing cervical cancer: a dream or the future? Ann. Oncol. 15:197-200). A crucial safety aspect of VLP vaccine regimes is that the VLPs used have to be free of viral genomes (DNA or RNA), since otherwise vaccination could induce virus replication and/or latent infection by the virus, EBV VLPs are likely to contain several dozen lytic proteins, including envelope, tegument and capsid proteins; EBV tegument proteins have been identified either by functional and structural characterization, or by homology to tegument proteins of other herpes viruses (Johannsen et al. (2004), Proc Natl Acad Sci USA 101: 16286; Tarbouriech et. al. (2006), Acta Cryst D62:1276; Feederle et al. (2006), J Viral 80(1):9435). However, EB-VLPs are devoid of latent proteins. Thus, by using an EBV vaccine based on EB-VLPs, an immune response to the proteins produced by EBV during latent infection cannot be expected.

An important branch of the adaptive immune system are epitope-specific T-cells. In humans, these cells have a T-cell-receptor on their surface, the recognition domain of which is specific for a defined complex between an antigenic peptide (T-cell epitope) and a major histocompatibility complex (MHC) protein. If the T-cell-receptor is engaged in a cognate interaction, the T-cell becomes activated, multiplies, and performs its activatory or inhibitory task in the immune response.

The MHC molecules come in two forms: MHC class I are expressed on the surface of every human cell and present, essentially randomly, peptides derived from proteins present in the cell's cytosol; they, thus, give a continuous overview of the protein repertoire of the cell and allow for recognition of non-normal protein expression, e.g. during viral infection of the cell or in carcinogenesis. In order to recognize MHC class I molecule-peptide complexes, the T-cell receptor requires the CD8 surface protein as a co-receptor. There is thus a subclass of T-cells expressing the CD8 co-receptor, named CD8+ T-cells; their main but not exclusive function is to eliminate body cells presenting peptides that indicate potential pathogenic processes in said cell, e.g. virus infection, which is why they are also called cytotoxic T-cells.

MHC class II are expressed only on professional antigen presenting cells (APCs). On these, peptides are presented that are derived from proteins that were ingested by the APCs, mainly by endocytosis. Recognition of MHC class II requires the coreceptor CD4, which is expressed only on the surface of CD4+ T-cells. The primary role of these T-cells, also called T-helper cells, is the activation of CD8+ T-cells, macrophages, and B-cells. Delivery of suitable epitopes to APCs thus leads to presentation of these epitopes via MHC class TT to helper T-cells, which in turn activates these T-cells and leads to the activation of the other branches of the immune system. Importantly, experimental evidence exists that co-engagement of the CD19/CD21 complex results in more rapid and efficient production of antigenic peptide/class II complexes as compared with engagement of the B cell receptor alone by the antigen (Fearon et al. (2000), Annu Rev Immunol 18:393-422).

There is, thus, a need in the art to provide reliable means for vaccination, in particular against EBV infection. Furthermore, there is a need to provide means and methods avoiding at least in part the drawbacks of the prior art as discussed above. This problem is solved by the subject matter with the features of the independent claims. Preferred embodiments, which might be realized in an isolated fashion or in any arbitrary combination are listed in the dependent claims.

Accordingly, the present invention relates to a preparation comprising Epstein-Barr virus-like particles (EB-VLPs), said. EB-VLPs being essentially free of Epstein Barr virus (EBV) DNA, wherein said EB-VLPs comprise a vaccination polypeptide comprising at least one peptide of EBV tegument polypeptide and at least one immunogenic peptide.

As used in the following, the terms "have", "comprise" or "include" or any arbitrary grammatical variations thereof are used in a non-exclusive way. Thus, these terms may both refer to a situation in which, besides the feature introduced by these terms, no further features are present in the entity described in this context and to a situation in which one or more further features are present. As an example, the expressions "A has B", "A comprises B" and "A includes B" may both refer to a situation in which, besides B, no other element is present in A (i.e. a situation in which A solely and exclusively consists of B) and to a situation in which, besides B, one or more further elements are present in entity A, such as element C, elements C and D or even further elements.

Further, as used in the following, the terms "preferably", "more preferably", "most preferably", "particularly", "more particularly", "specifically", "more specifically" or similar terms are used in conjunction with optional features, without restricting further possibilities. Thus, features introduced by these terms are optional features and are not intended to restrict the scope of the claims in any way. The invention may, as the skilled person will recognize, be performed by using alternative features. Similarly, features introduced by "in an embodiment" or similar expressions are intended to be optional features, without any restriction regarding further embodiments of the invention, without any restrictions regarding the scope of the invention and without any restriction regarding the possibility of combining the features introduced in such way with other optional or non-optional features of the invention.

As used herein, the term "standard conditions", if not otherwise noted, relates to IUPAC standard ambient temperature and pressure (SATP) conditions, i.e. preferably, a temperature of 25° C. and an absolute pressure of 100 kPa, also preferably, standard conditions include a pH of 7. Moreover, if not otherwise indicated, the term "about" relates to the indicated value with the commonly accepted technical precision in the relevant field, preferably relates to the indicated value ±20%, more preferably ±10%, most preferably ±5%. Further, the term "essentially", if not otherwise defined herein below, indicates that deviations having influence on the indicated result or use are absent, i.e. potential deviations do not cause the indicated result to deviate by more than ±20%, more preferably ±10%, most preferably ±5%. Thus, "consisting essentially of" means including the components specified but excluding other components except for materials present as impurities, unavoidable materials present as a result of processes used to provide the components, and components added for a purpose other than achieving the technical effect of the invention. For example, a composition defined using the phrase "consisting essentially of" encompasses any known acceptable additive, excipient, diluent, carrier, and the like. Preferably, a composition consisting essentially of a set of components will comprise less than 5% by weight, more preferably less than 3% by weight, even more preferably less than 1%, most preferably less than 0.1% by weight of non-specified component(s). In the context of nucleic acid sequences, the term "essentially identical" indicates a % identity value of at least 80%, preferably at least 90%, more preferably at least 98%, most preferably at least 99%. As will be understood, the term essentially identical includes 100% identity. The aforesaid applies to the term "essentially complementary" mutatis mutandis.

The term "Epstein-Barr virus-like particles" or "EB-VLPs" as used herein refers to viral particles derived from an EBV neither replicating lytically nor establishing latent infection in a suitable host cell. EB-VLPs, preferably, have an essentially typical herpesviral structure as analyzed by electron microscopy, i.e. they have a capsid, a tegument, and an outer membrane. However, in contrast to the normal herpesviral particle, the EB-VLPs of the present invention are empty, i.e. they do not contain EBV DNA, preferably no DNA at all. The EB-VIPs comprise the EB-viral proteins (e.g., capsid, tegument, coat, shell, surface or envelope proteins and glycoproteins) known to the skilled artisan for the known. EBV types (e.g. EBV type 1: Geribank Ace No: NC_007605.1; de Jesus O et al. (2003) J. Gen. Virol. 84, 14434450 and EBV type 2: Genbank Acc No: NC_009334.1, Dolan A et al. (2006) Virology Vol. 350, 164-170), including strain M81 (SEQ ID NO: 38 in. WO 2013/098364).

In addition to EBV-encoded proteins, the EB-VLPs referred to herein also comprise at least one vaccination polypeptide as specified elsewhere herein. Moreover, the EB-VLPs, preferably, may further comprise one or more artificial polypeptides. The term "artificial polypeptide" relates to any polypeptide incorporated into an EB-VIP which is not comprised in a wildtype EBV. Whether an artificial polypeptide is incorporated into, and therefore comprised in, an EB-VLP, can be assessed by obtaining EB-VLPs according to the methods of the present invention, separating EB-VLPs from the producing cells, e.g. by centrifugation or by immunoprecipitation as described in the examples below, followed by determining the presence of the artificial polypeptide in said EB-VLPs, which can be accomplished e.g. by the immunoblot method described in WO 2013/098364 or by any other method suited for the specific polypeptide and known to the artisan. Preferably, the artificial polypeptide is a fusion polypeptide comprising a membrane-integral part of a herpesviral glycoprotein.

It is, however, also envisaged by the present invention that one or more non-essential EB-viral polypeptides is or are lacking from the EB-VLP. In the context of the present specification, "non-essential EBV polypeptide" relates to a polypeptide incorporated into wildtype EB-viral particles but not essential for the formation of EB-VLPs. A polypeptide is non-essential if VLPs are detectable by electron microcopy or one of the other methods described in the examples of WO 2013/098364 after suitable host cells have been induced to produce VLPs according to the methods of the present specification in the absence of said polypeptide. E.g., the product of the EBV wildtype BNRF1 gene may be lacking from an EB-VLP. Moreover, in particular in case the vaccination polypeptide comprises an N-terminal or C-terminal fusion of the vaccination polypeptide to the EBV tegument polypeptide as specified elsewhere herein, the wildtype variant of said EBV tegument polypeptide is preferably absent from the EB-VLP. Methods how to omit a polypeptide from a host cell during lytic infection of EBV are well-known to the skilled artisan. Preferably, a polypeptide is omitted by deleting the gene coding for said polypeptide from the viral genome or by rendering said gene inexpressible by means of genetic manipulation, e.g. by mutating the start codon to a non-start codon.

The term "substantially free of EBV DNA" as used herein will be understood by those skilled in the art. Said term does not necessarily mean that all EB-VLPs are free of EBV DNA. The term, however, requires that the fraction of EBV DNA free EB-VIPs relative to the total number of EBV particles (i.e. the sum of EBV particles comprising EBV DNA and EB-VLPs free of EBV DNA) in the preparation is increased at least 1000 fold, preferably at least $10^4$ fold, more preferably at least $10^5$ fold, even more preferably at east $10^6$ fold compared to wildtype EBV, preferably compared to strain B95.8. Thus, preferably, EB-VLPs substantially free of EBV DNA are EB-VLPs containing less than 10000 EBV genomes/ml supernatant, more preferably less than 1000 EBV genomes/ml supernatant, even more preferably less than 100 EBV genomes/ml supernatant, and most preferably less than 10 EBV genomes/ml supernatant, preferably when produced and assayed in the PCR assay as described in the examples of WO 2013/098364. Preferably, the number of EBV genomes is less than $100/10^6$ EBV-VLPs, more preferably less than $10/10^6$ EBV-VLPs, even more preferably less than $1/10^6$ EBV-VLPs, still more preferably less than $0.1/10^6$ EBV-VLPs, most preferably less than. $0.01/10^6$ EBV-VLPs. Preferably, EB-VLPs substantially free of EBV DNA are EB-VLPs establishing latent infection in Raji cells at a rate of less than 10 infected cells/ml supernatant, more preferably less than 1 infected cell/ml supernatant, even more preferably less than 0.1 infected cells/nil supernatant, most preferably less than 0.01 infected cells/mi supernatant when produced and assayed in the infection assay as described in WO 2013/09836. Preferably, the rate is less than 10 infected Raji cells/$10^6$ EB-VLPs, more preferably less than. 1 infected cell/$10^6$ EB-VIPs, even more preferably less than 0.1 infected cells/ $10^6$ EB-VLPs, most preferably less than 0:01 infected cells/ $10^6$ EB-VLPs.

As used in this specification, the term "vaccination polypeptide" relates to any chemical molecule comprising at least one peptide of an EBV tegument polypeptide and at least one immunogenic peptide as specified herein below. It is to be understood that the chemical linkage between the EBV tegument polypeptide and the immunogenic peptide(s) need not necessarily be a peptide bond. It is also envisaged that the chemical bond between the EBV tegument polypeptide and the immunogenic peptide(s) is an ester bond, a disulfide bond, or any other suitable covalent chemical bond known to the skilled artisan. Also envisaged are non-covalent bonds with a dissociation constant so low that the immunogenic peptide(s) will only dissociate to a negligible extent from the EBV tegument polypeptide. Preferably, the dissociation constant for said non-covalent bond is less than $10^{-5}$ mol/l (as it is the case with the Strep-Tag:Strep-Tactin binding), less than $10^{-6}$ mol/l (as it is the case in the Strep-TagII:Strep-Tactin binding), less than $10^{-8}$ mol/l, less than $10^{-10}$ mol/l or less than $10^{-12}$ mol/l (as it is the case for the Streptavidin:Biotin binding) Methods of determining dissociation constants are well known to the skilled artisan and include, e.g., spectroscopic titration methods, surface plasmon resonance measurements, equilibrium dialysis and the like. Preferably, the vaccination polypeptide does not comprise one or more peptide sequences known to inhibit antigen presentation. Moreover, preferably, the vaccination polypeptide does not comprise genetic material, i.e. polynucleotides. In a preferred embodiment, the vaccination polypeptide consists of the components as described herein.

Preferably, the chemical linkage between the EBV tegument polypeptide and the immunogenic peptide(s) is a peptide bond, i.e. the vaccination polypeptide is a fusion polypeptide comprising or consisting of the EBV tegument polypeptide and the immunogenic peptide of the present invention. Preferably, the immunogenic peptide is fused to the N-terminus of said EBV tegument polypeptide, is fused to the C-terminus of said EBV tegument polypeptide, or is inserted into the amino acid sequence of said. EBV tegument polypeptide and/or replaces amino acids of said EBV tegument polypeptide. More preferably, as specified elsewhere herein, the immunogenic peptide is fused to the N-terminus of the BNRF1 polypeptide, is fused to the C-terminus of the BNRF1 polypeptide, or is inserted into the amino acid sequence of the BNRF1 polypeptide. Still more preferably, the immunogenic peptide is inserted into said BNRF1 polypeptide at any one of positions 1 to 172 of the BNRF1 polypeptide and/or replaces amino acids within said positions. Most preferably, the immunogenic peptide is inserted into said BNRF1 polypeptide at position, i.e. after amino acid, 113. Thais, preferably, the vaccination polypeptide comprises, preferably consists of, the amino acid sequence of SEQ ID NO:1, 2, or 3, or a variant thereof at least 70%, more preferably at least 80%, still more preferably at least 90%, still more preferably at least 95%, most preferably at least 99% identical thereto; most preferably, the vaccination polypeptide comprises, preferably consists of, the amino acid sequence of SEQ ID NO: 1, 2, or 3.

As used herein, the term "polypeptide variant" relates to any chemical molecule comprising at least one polypeptide or fusion polypeptide as specified elsewhere herein, having the indicated activity, but differing in primary structure from said polypeptide or fusion polypeptide indicated. Thus, the polypeptide variant, preferably, is a mutein having the indicated activity. Preferably, the polypeptide variant comprises a peptide having an amino acid sequence corresponding to an amino acid sequence of 100 to 2000, more preferably 200 to 1800, even more preferably 300 to 1600, or, most preferably, 500 to 1500 consecutive amino acids comprised in a polypeptide as specified above. Moreover, also encompassed are further polypeptide variants of the aforementioned polypeptides. Such polypeptide variants have at least essentially the same biological activity as the specific polypeptides. Moreover, it is to be understood that a polypeptide variant as referred to in accordance with the present invention shall have an amino acid sequence which differs due to at least one amino acid substitution, deletion and/or addition, wherein the amino acid sequence of the variant is still, identical with the amino acid sequence of the specific polypeptide to an extent as specified. The degree of identity between two amino acid sequences can be determined by algorithms well known in the art. Preferably, the degree of identity is determined by comparing two optimally aligned sequences over a comparison window, where the fragment of amino acid sequence in the comparison window may comprise additions or deletions (e.g., gaps or overhangs) as compared to the sequence it is compared to for optimal alignment. The percentage is calculated by determining, preferably over the whole length of the polypeptide, the number of positions at which the identical amino acid residue occurs in both sequences to yield the number of matched positions, dividing the number of matched positions by the total number of positions in the window of comparison and multiplying the result by 100 to yield the percentage of sequence identity. Optimal alignment of sequences for comparison may be conducted by the local homology algorithm of Smith and Waterman (1981), by the homology alignment algorithm of Needleman and Wunsch (1970), by the search flor similarity method of Pearson and Lipman (1988), by computerized implementations of these algorithms (GAP, BESTFIT, BLAST, PASTA, and TFASTA in the Wisconsin Genetics Software Package, Genetics Computer Group (GCG), 575 Science Dr., Madison, Wis.), or by visual inspection. Given that two sequences have been identified for comparison, GAP and BESTFIT are preferably employed to determine their optimal alignment and, thus, the degree of identity. Preferably, the default values of 5.00 for gap weight and 0.30 for gap weight length are used. Polypeptide variants referred to herein may be allelic variants or any other species specific homologs, paralogs, or orthologs. Moreover, the polypeptide variants referred to herein include fragments of the specific polypeptides or the aforementioned types of polypeptide variants as long as these fragments and/or variants have the biological activity or activities as referred to herein. Such fragments may be or be derived from, e.g., degradation products or splice variants of the polypeptides. Further included are variants which differ due to posttranslational modifications such as phosphorylation, glycosylation, ubiquitinylation, sumoylation, or myristylation, by including non-natural amino acids, and/or by being peptidomimetics.

Preferably, the vaccination polypeptide and/or the artificial polypeptide, if present, further comprise a detectable tag. The term "detectable tag" refers to a stretch of amino acids which are added to or introduced into the vaccination polypeptide of the invention. Preferably, the tag shall be added C- or N-terminally to the vaccination polypeptide of the present invention. The stretch of amino acids shall allow for detection of the fusion polypeptide by an antibody which specifically recognizes the tag or it shall allow for forming a functional conformation, such as a chelator or it shall allow for visualization by fluorescence. Preferred tags are the Myc-tag, FLAG-tag, 6-His-tag, HA-tag, GST-tag or GFP-tag. These tags are all well known in the art. Preferably, a tag as specified above, more preferably a Myc-tag, FLAG-tag, 6-His-tag, HA-tag, GST-tag or GFP-tag, is not an immunogenic peptide as referred to herein.

The term "EBV tegument polypeptide", as used herein, relates to a polypeptide known to have at least the biological activity of being incorporated into the tegument of EBV particles i.e. wildtype EBV particles and/or EB-VLP as specified herein, or a fragment thereof having said biological activity. Thus, preferably, the EBV tegument polypeptide is the BNRF1 polypeptide (Genbank Acc No: P03179.1), the BBLF1 polypeptide (Genbank Acc No: P0CK52.1), the BDLF2 polypeptide (Genbank Acc No: P03225.1), the BGLF1 polypeptide (Genbank Acc No: P03222.1), the BGLF2 polypeptide (Genbank Acc No: P0CK54.1), the BKRF4 polypeptide (Genbank Acc No: P30117.1), the BLRF2 polypeptide (Genbank Acc No: P03197.1), the BOLF1 polypeptide (Genbank Acc No: P03189.1), the BPLF1 polypeptide (Genbank Acc No: P03186.1), the BRRF1 polypeptide (Genbank Acc No: P03207.1), the BSRF1 polypeptide (Genbank Acc No: P0CK50.1), or a fragment of one of said polypeptides having the biological activity described above. More preferably, the EBV tegument polypeptide is the BNRF1 polypeptide or a fragment thereof having said biological activity. Most preferably, the EBV tegument polypeptide is the BNRF1 polypeptide. As will be understood by the skilled person, the term "fragment" in the context of the EBV tegument polypeptide referred to herein includes N-terminal fragments, C-terminal fragments, as well as an EBV tegument polypeptide in which one or more amino acids were replaced by different amino acids, i.e. a polypeptide comprising an N-terminal and a C-terminal portion of said EBV tegument polypeptide.

The term "immunogenic peptide" is understood by the skilled person to relate to any peptide which, when administered to a subject, has the activity of inducing an immune response to itself and, preferably, to compounds comprising said immunogenic peptide. As the skilled person understands, not every immunogenic peptide will have the aforesaid activity in each subject; e.g. an immunogenic peptide restricted by (i.e. presented in the context of) a specific subtype of MHC molecule, can only be immunogenic in a subject having said MHC subtype. Thus, as used herein, the term immunogenic peptide relates to a peptide having the activity of inducing an immune response in a suitable subject.

Preferably, the immunogenic peptide comprises at least one T-cell epitope. A T-cell epitope, as is known to the one skilled in the art, is a contiguous sequence of amino acids comprised in a peptide or polypeptide, which can be bound to a major histocompatibility complex (MHC) class I or class II molecule to be presented on the surface of a cell (MHC-I) or of a professional antigen presenting cell (MHC-II). The skilled artisan knows how to predict immunogenic peptides presented on MHC-I or MHC-II (Nielsen et al., (2004), Bioinformatics, 20 (9), 1388-1397), Bordner (2010), PLoS ONE 5(12): e14383) and how to evaluate binding of specific peptides (e.g. Bernardeau et al., (2011), J Immunol Methods, 371(1-2):97-105). Also, T-cell epitopes are available in public databases, e.g. from the immune epitope database. Preferably, the T-cell epitope is an MHC-II epitope. Preferably, the T-cell epitope is an epitope derived from a tumor antigen, i.e. an amino acid sequence comprised in a protein expressed essentially only in or on a tumor cell. More preferably, the T-cell epitope is an epitope derived from a B-cell lymphoma tumor antigen. Also preferably, the at least one immunogenic peptide is an immunogenic peptide of a pathogenic microorganism, preferably of a virus, more preferably of a herpes virus. More preferably, the at least one immunogenic peptide is an immunogenic EBV peptide, still more preferably of a latent EBV polypeptide. Thus preferably, the at least one immunogenic peptide comprises an amino acid sequence of at least one sequence selected from SEQ ID NOs:32 to 210, preferably from SEQ ID NOs:32 to 96. More preferably, the at least one immunogenic peptide is an immunogenic peptide of a latent EBV polypeptide comprising at least one T-cell epitope, preferably selected from SEQ ID NOs:32 to 91 and 97 to 161. Even more preferably, the at least one immunogenic peptide is an immunogenic peptide of a latent EBV polypeptide comprising at least one T-cell epitope, preferably selected from SEQ ID NOs:32 to 91, preferably comprising at least one MHC class II epitope. Preferably, the latent EBV polypeptide is selected from the list consisting of EBNA-1, EBNA-LP, EBNA-2, EBNA-3A, EBNA-3B, EBNA-3C, LMP-1, and LMP-2A; more preferably is EBNA-1 (Long et al. (2011), Curr Opin Immunol 23(2):258-64).

Preferably, the immunogenic peptide is a peptide presented by an MI-IC class I molecule, preferably stimulating CD8+ T-cells; thus, more preferably, the immunogenic peptide comprises at least one amino acid sequence selected from SEQ ID NOs: 97, 99 to 109, 111 to 119, 121 to 136, 138, 141 to 144, 147, 149 to 156, 158 to 161, and 164 to 194, preferably selected from SEQ ID NOs: 97, 99 to 109, 111 to 119, 121 to 136, 138, 141 to 144, 147, 149 to 156, and 158 to 161. More preferably, the immunogenic peptide is a peptide presented by an MHC class II molecule, preferably stimulating CD4+ T-cells; thus, more preferably, the immunogenic peptide comprises at least one amino acid sequence selected from SEQ ID NOs:32 to 91, 98, 110, 120, 137, 139, 140, 145, 146, 148, 157, 162, 163, and 195 to 210 preferably selected from SEQ ID NOs:32 to 91, 98, 110, 120, 137, 139, 140, 145, 146, 148, and 157, most preferably from SEQ ID NOs:32 to 91.

Preferably, the T-cell epitope is a strong T-cell epitope, term "strong T-cell epitope" relating to a T-cell epitope for which the probability that T-cells recognizing said T-cell epitope are present in a subject is high. Thus, preferably, T-cells recognizing the strong T-cell epitope are present at a high frequency in a subject. Preferably, the T-cell epitopes are selected from the proteins of viruses commonly infecting said subject, or against which said subject has been vaccinated. Most preferred immunogenic peptides are peptides comprising epitopes from EBV latent antigens such as the EBNA1 3E10 epitope (NPKFENIAEGLRALL, SEQ ID NO:32), the EBNA 3G2 epitope (KTSLYNLRRGTALAI, SEQ ID NO:33), the EBNA3C 5H11 epitope (ENPYHARRGIKEHVI, SEQ ID NO:34), the EBNA-3C 3H10 epitope (VVRMFMRERQLPQS, SEQ ID NO:35) and/or a sequence of at least 7, preferably at least 8, more preferably at least 9, most preferably at least 10 amino acids of SEQ ID NO:36. Preferably, the immunogenic polypeptide is not a BNRF1 polypeptide, more preferably is not an immunogenic polypeptide derived from a tegument polypeptide of EBV.

The term "preparation" is understood by the skilled person to relate to any composition of matter comprising at least the indicated components. Thus, the preparation may comprise further components as well, in particular at least one solvent, preferably water, a buffer, preferably a phosphate, formate, acetate, or citrate buffer, and/or one or more salts, preferably sodium chloride, potassium chloride, or the like. Preferably, the preparation is a pharmaceutical composition.

The term "pharmaceutical composition", as used herein, relates to a composition comprising the compound or compounds of the present invention in a pharmaceutically acceptable form and a pharmaceutically acceptable carrier. The compounds of the present invention can be formulated as pharmaceutically acceptable salts. Acceptable salts comprise acetate, HCl, sulfate, chloride salts, and the like. The pharmaceutical compositions are, preferably, administered topically or systemically. Suitable routes of administration conventionally used for drug administration are oral, intravenous, or parenteral administration as well as inhalation. Preferably, the pharmaceutical composition of the present invention is administered via a parenteral route, preferably subcutaneously, intramuscularly, or intraperitoneally. In case the subject is a human, administration preferably is intramuscularly, or, more preferably, intravenously. However, polynucleotide compounds may also be administered in a gene therapy approach by using viral vectors, viruses or liposomes, and may also be administered topically, e.g. as an ointment. Moreover, the compounds can be administered in combination with other drugs either in a common pharmaceutical composition or as separated pharmaceutical compositions wherein said separated pharmaceutical compositions may be provided in form of a kit of parts. In particular, additional administration of adjuvants may be envisaged.

The compounds are, preferably, administered in conventional dosage forms prepared by combining the components with standard pharmaceutical carriers according to conventional procedures. These procedures may involve mixing, granulating and compressing or dissolving the ingredients as appropriate to the desired preparation, it will be appreciated that the form and character of the pharmaceutically acceptable carrier or diluent is dictated by the amount of active ingredient with which it is to be combined, the route of administration and other well-known variables.

The carrier(s) must be acceptable in the sense of being compatible with the other ingredients of the formulation and being not deleterious to the recipient thereof. The pharmaceutical carrier employed may be, for example, either a solid, a gel or a liquid, preferably is an aqueous liquid. Thus, exemplary of liquid carriers are phosphate buffered saline solution, syrup, oil such as peanut oil and olive oil, water, emulsions, various types of wetting agents, sterile solutions and the like. Said suitable carriers comprise those mentioned above and others well known in the art, see, e.g., Remington's Pharmaceutical Sciences, Mack Publishing Company, Easton, Pa. The diluent(s) is/are preferably selected so as not to affect the biological activity of the VLPs, vaccination polypeptide, polynucleotide, vector, and/or host cell and potential further pharmaceutically active ingredients. Examples of such diluents are distilled water, physiological saline, Ringer's solutions, dextrose solution, and flank's solution. In addition, the pharmaceutical composition or formulation may also include other carriers, adjuvants, or nontoxic, nontherapeutic, nonimmunogenic stabilizers and the like.

A therapeutically effective dose refers to an amount of the compounds to be used in a pharmaceutical composition of the present invention which prevents, ameliorates or treats a condition referred to herein. Therapeutic efficacy and toxicity of compounds can be determined by standard pharmaceutical procedures in cell culture or in experimental animals, e.g., by determining the $ED_{50}$ (the dose therapeutically effective in 50% of the population) and/or the $LD_{50}$ (the dose lethal to 50% of the population). The dose ratio between therapeutic and toxic effects is the therapeutic index, and it can be expressed as the ratio, $LD_{50}/ED_{50}$.

The dosage regimen will be determined by the attending physician, preferably taking into account relevant clinical factors and, preferably, in accordance with any one of the methods described elsewhere herein. As is well known in the medical arts, a dosage for any one patient ay depend upon many factors, including the patient's size, body surface area, age, the particular compound to be administered, sex, time and route of administration, general health, and other drugs being administered concurrently. Progress can be monitored by periodic assessment. A typical dose can be, for example, in the range of 1 µg to 10000 µg; however, doses below or above this exemplary range are envisioned, especially considering the aforementioned factors, Generally, the regimen comprises administration of 1 µg to 10 µg of an antigen as a primary immunization, followed by one or more than one boost administration of the same antigen, preferably in the same dosage. However, depending on the subject and the mode of administration, the quantity of substance administration may vary over a wide range to provide from about 0.01 mg per kg body mass to about 1 mg per kg body mass, preferably. The pharmaceutical compositions and formulations referred to herein are administered at least once in order to treat or prevent a disease or condition recited in this specification. However, the said pharmaceutical compositions may be administered more than one time, for example, preferably from one to four times, more preferably two or three times.

Specific pharmaceutical compositions are prepared in a manner well known in the pharmaceutical art and comprise at least an vaccination polypeptide, polynucleotide, vector, or host cell as an active compound in admixture or otherwise associated with a pharmaceutically acceptable carrier or diluent. For making those specific pharmaceutical compositions, the active compound(s) will usually be mixed with a carrier or the diluent, or enclosed or encapsulated in a capsule, sachet, cachet, paper or other suitable containers or vehicles. The resulting formulations are to be adopted to the mode of administration, i.e. in the forms of tablets, capsules, suppositories, solutions, suspensions or the like. Dosage recommendations shall be indicated in the prescriber or user instructions in order to anticipate dose adjustments depending on the considered recipient.

Advantageously, it was found that the immunogenic spectrum of EBV particles can be increased by including immunogenic peptides into a tegument protein of EBV, which is then incorporated into an EB-VLP; by this method, it is possible to induce an immune response against structural (lytic) antigens as well as latent antigens, improving overall immunity.

The definitions made above apply mutatis mutandis to the following. Additional definitions and explanations made further below also apply for all embodiments described in this specification mutatis mutandis.

The present invention further relates to a polynucleotide encoding the vaccination polypeptide of the present invention.

The term "polynucleotide" as used in accordance with the present invention relates to a polynucleotide comprising a nucleic acid sequence which encodes a polypeptide having the activity of being a vaccination polypeptide as specified elsewhere herein. Suitable assays for measuring the activities mentioned before are described in the accompanying Examples. A polynucleotide encoding a polypeptide having the aforementioned biological activity has been obtained in accordance with the present invention from EBV BNRF1; thus, the polynucleotide, preferably, comprises the nucleic acid sequence shown in SEQ ID NO: 4, 5, or 6 encoding a polypeptide having an amino acid sequence as shown in SEQ ID NO: 1, 2, or 3, respectively. It is to be understood that a polypeptide having an amino acid sequence as shown in SEQ ID NO: 1, 2, or 3 may be also encoded due to the degenerated genetic code by other polynucleotides as well.

As used herein, the term polynucleotide, preferably, includes variants of the specifically indicated polynucleotides. More preferably, the term polynucleotide relates to the specific polynucleotides indicated. It is to be understood, however, that a polypeptide having a specific amino acid sequence may be also encoded by a variety of polynucleotides, due to the degeneration of the genetic code. The skilled person knows how to select a polynucleotide encoding a polypeptide having a specific amino acid sequence and also knows how to optimize the codons used in the polynucleotide according to the codon usage of the organism used for expressing said polynucleotide. Thus, the term "polynucleotide variant", as used herein, relates to a variant of a polynucleotide related to herein comprising a nucleic acid sequence characterized in that the sequence can be derived from the aforementioned specific nucleic acid sequence by at least one nucleotide substitution, addition and/or deletion, wherein the polynucleotide variant shall have the activity as specified for the specific polynucleotide, i.e. shall encode an vaccination polypeptide according to the present invention. Moreover, it is to be understood that a polynucleotide variant as referred to in accordance with the present invention shall have a nucleic acid sequence which differs due to at least one nucleotide substitution, deletion and/or addition. Preferably, said polynucleotide variant is an ortholog, a paralog or another homolog of the specific polynucleotide. Also preferably, said polynucleotide variant is a naturally occurring allele of the specific polynucleotide. Polynucleotide variants also encompass polynucleotides comprising a nucleic acid sequence which is capable of hybridizing to the aforementioned specific polynucleotides, preferably, under stringent hybridization conditions. These stringent conditions are known to the skilled worker and can be found in Current Protocols in Molecular Biology, John Wiley & Sons, N. Y. (1989), 6.3.1-6.3.6. A preferred example for stringent hybridization conditions are hybridization conditions in 6× sodium chloride/sodium citrate (=SSC) at approximately 45° C., followed by one or more wash steps in 0.2×SSC, 0.1% SDS at 50 to 65° C. The skilled worker knows that these hybridization conditions differ depending on the type of nucleic acid and, for example when organic solvents are present, with regard to the temperature and concentration of the buffer. For example, under "standard hybridization conditions" the temperature differs depending on the type of nucleic acid between 42° C. and 58° C. in aqueous buffer with a concentration of 0.1× to 5×SSC (pH 7.2). If organic solvent is present in the abovementioned buffer, for example 50% formamide, the temperature under standard conditions is approximately 42° C. The hybridization conditions for DNA:DNA hybrids are preferably for example 0.1×SSC and 20° C. to 45° C., preferably between 30° C. and 45° C. The hybridization conditions for DNA:RNA hybrids are preferably, for example, 0.1×SSC and 30° C. to 55° C., preferably between 45° C. and 55° C. The abovementioned hybridization temperatures are determined for example for a nucleic acid with approximately 100 bp (=base pairs) in length and a G+C content of 50% in the absence of formamide. The skilled worker knows how to determine the hybridization conditions required by referring to textbooks such as the textbook mentioned above, or the following textbooks: Sambrook et al., "Molecular Cloning", Cold Spring Harbor Laboratory, 1989; Hames and Higgins (Ed.) 1985, "Nucleic Acids Hybridization: A Practical Approach", IRL Press at Oxford University Press, Oxford; Brown (Ed.) 1991, "Essential Molecular Biology: A Practical Approach", WI. Press at Oxford University Press, Oxford. Alternatively, polynucleotide variants are obtainable by PCR-based techniques such as mixed oligonucleotide primer-based amplification of DNA, i.e. using degenerated primers against conserved domains of a polypeptide of the present invention. Conserved domains of a polypeptide may be identified by a sequence comparison of the nucleic acid sequence of the polynucleotide or the amino acid sequence of the polypeptide of the present invention with sequences of other organisms. As a template, DNA or cDNA from bacteria, fungi, plants or, preferably, from animals may be used. Further, variants include polynucleotides comprising nucleic acid sequences which are at least 70%, at least 75%, at least 80%, at least 85%, at least 90%, at least 95%, at least 98% or at least 99% identical to the specifically indicated nucleic acid sequences. Moreover, also encompassed are polynucleotides which comprise nucleic acid sequences encoding amino acid sequences which are at least 70%, at least 75%, at least 80%, at least 85%, at least 90%, at least 95%, at least 98% or at least 99% identical to the amino acid sequences specifically indicated. The percent identity values are, preferably, calculated over the entire amino acid or nucleic acid sequence region. A series of programs based on a variety of algorithms is available to the skilled worker for comparing different sequences. In this context, the algorithms of Needleman and Wunsch or Smith and Waterman give particularly reliable results. To carry out the sequence alignments, the program PileUp (J. Mol. Evolution., 25, 351-360, 1987, Higgins et al., CABIOS, 5 1989: 151-153) or the programs Gap and BestFit Needleman and Wunsch (J. Mol. Biol. 48; 443-453 (1970)) and Smith and Waterman (Adv. Appl. Math. 2; 482-489 (1981))], which are part of the GCG software packet (Genetics Computer Group, 575 Science Drive, Madison, Wis., USA 53711 (1991)), are to be used. The sequence identity values recited above in percent (%) are to be determined, preferably, using the program GAP over the entire sequence region with the following settings: Gap Weight: 50, Length Weight: 3, Average Match: 10.000 and Average Mismatch: 0.000, which, unless otherwise specified, shall always be used as standard settings for sequence alignments.

A polynucleotide comprising a fragment of any of the specifically indicated nucleic acid sequences is also encompassed as a variant polynucleotide of the present invention, provided that the polypeptide encoded has the activity or activities as specified. Thus, the fragment shall still encode a vaccination polypeptide which still has the activity as specified. Accordingly, the vaccination polypeptide encoded may comprise or consist of the domains of the vaccination polypeptide of the present invention conferring the said biological activity. A fragment as meant herein, preferably, comprises at least 150, at least 200, at least 500 or at least 1000 consecutive nucleotides of any one of the specific nucleic acid sequences or encodes an amino acid sequence comprising at least 200, at least 300, at least 500, at least 800, at least 1000 or at least 1500 consecutive amino acids of any one of the specific amino acid sequences.

The polynucleotides of the present invention either consist, essentially consist of, or comprise the aforementioned nucleic acid sequences. Thus, they may contain further nucleic acid sequences as well. Specifically, the polynucleotides of the present invention may encode fusion proteins wherein one partner of the fusion protein is a vaccination polypeptide being encoded by a nucleic acid sequence recited above. Such fusion proteins may comprise as additional part polypeptides for monitoring expression, so called "tags" which may serve as a detectable marker or as an auxiliary measure for purification purposes. Tags for the different purposes are well known in the art and are described elsewhere herein.

The polynucleotide of the present invention shall be provided, preferably, either as an isolated polynucleotide (i.e. isolated from its natural context) or in genetically modified form. The polynucleotide, preferably, is DNA, including cDNA, or is RNA. The term encompasses single as well as double stranded polynucleotides. Moreover, preferably, comprised are also chemically modified polynucleotides including naturally occurring modified polynucleotides such as glycosylated or methylated polynucleotides or artificially modified ones such as biotinylated polynucleotides.

Preferably, the polynucleotide further encodes an EBV genome. As used herein, the term "polynucleotide encoding an EBV genome" relates to a polynucleotide comprising all EBV genes required for the generation of EB-VIPs. Thus, a polynucleotide encoding an EBV genome has the biological activity of directing production of EB-VLPs according to the present specification in a suitable host cell. Suitable assays for measuring said activity are described in the accompanying examples. As used herein, the term does not require that the EBV genome encoded can establish latent infection or promote inclusion of said EBV genome into an infectious EBV particle. Preferably, the EBV genome comprised in said polynucleotide lacks EBV terminal repeat sequences, as described e.g. in Ruiss et al. ((2011), J Virol 85(24):13105); and/or lacks at least one functionally expressible gene selected from the BFLF1 gene and the BBRF1 gene. Thus, preferably, the polynucleotide comprises one of the nucleic acid sequences shown in SEQ ID NO: 27 of WO 2013/098364 (an EBV type 1 genome comprising a BFLF1 knockout, i.e. lacking an expressible BFLF1 gene, SEQ ID NO:10) and in SEQ ID NO: 28 of WO 2013/098364 (an EBV type 1 genome comprising a BBRF1 knockout, i.e. lacking an expressible BBRF1 gene, SEQ ID NO:11). More preferably, said polynucleotide comprises, preferably consists of, the sequence of SEQ ID NO:7, 8, or 9. Furthermore, the present invention relates to a vector comprising the polynucleotide according to the present invention.

The term "vector", preferably, encompasses phage, plasmid, viral or retroviral vectors as well artificial chromosomes, such as bacterial or yeast artificial chromosomes. Moreover, the term also relates to targeting constructs which allow for random or site directed integration of the targeting construct into genomic DNA. Such target constructs, preferably, comprise DNA of sufficient length for either homologous or heterologous recombination as described in detail below. The vector encompassing the polynucleotide of the present invention, preferably, further comprises selectable markers for propagation and/or selection in a host. The vector may be incorporated into a host cell by various techniques well known in the art. For example, a plasmid vector can be introduced in a precipitate such as a calcium phosphate precipitate or rubidium chloride precipitate, or in a complex with a charged lipid or in carbon-based clusters, such as fullerenes. Alternatively, a plasmid vector may be introduced by heat shock or electroporation techniques. In a preferred embodiment, the vector is a bacterial vector. Also preferably, the vector is an EBV vector. More preferably, the vector comprises a bacterial origin of replication and an EBV origin of replication.

More preferably, in the vector of the invention the polynucleotide is operatively linked to expression control sequences allowing expression in prokaryotic or eukaryotic cells or isolated fractions thereof. Expression of said polynucleotide comprises transcription of the polynucleotide, preferably into a translatable mRNA. Regulatory elements ensuring expression in eukaryotic cells, preferably mammalian cells, are well known in the art. They, preferably, comprise regulatory sequences ensuring initiation of transcription and, optionally, poly-A signals ensuring termination of transcription and stabilization of the transcript. Additional regulatory elements may include transcriptional as well as translational enhancers. Possible regulatory elements permitting expression in prokaryotic host cells comprise, e.g., the lac, trp or tac promoter in *E. coli*, and examples for regulatory elements permitting expression in eukaryotic host cells are the AOX1 or GAL1 promoter in yeast or the CMV-, SV40-, RSV-promoter (Rous sarcoma virus), CMV-enhancer, SV40-enhancer or a globin intron in mammalian and other animal cells. Moreover, inducible expression control sequences may be used in an expression vector encompassed by the present invention. Such inducible vectors may comprise tet or lac operator sequences or sequences inducible by heat shock or other environmental factors. Suitable expression control sequences are well known in the art. Beside elements which are responsible for the initiation of transcription such regulatory elements may also comprise transcription termination signals, such as the SV40-poly-A site or the tk-poly-A site, downstream of the polynucleotide. In this context, suitable expression vectors are known in the art such as Okayama-Berg cDNA expression vector pcDV1 (Pharmacia), pBluescript (Stratagene), pCDM8, pRc/CMV, pcDNA1, pcDNA3 (InVitrogene) or pSPORT1 (GIBCO BRL). Methods which are well known to those skilled in the art can be used to construct recombinant viral vectors; see, for example, the techniques described in Sambrook, Molecular Cloning A Laboratory Manual, Cold Spring Harbor Laboratory (1989) N.Y. and Ausubel, Current Protocols in Molecular Biology, Green Publishing Associates and Wiley Interscience, N.Y. (1994).

The present invention also relates to a host cell comprising the vaccination polypeptide according to the present invention, the polynucleotide according to the present invention, and/or the vector according to the present invention.

As used herein, the term "host cell" relates to any cell capable of receiving and, preferably maintaining, the polynucleotide and/or the vector of the present invention. More preferably, the host cell is capable of expressing a vaccination polypeptide of the present invention encoded on said polynucleotide and/or vector, Preferably, the cell is a bacterial cell, more preferably a cell of a common laboratory bacterial strain known in the art, most preferably an *Escherichia* strain, in particular an *E. coli* strain. Also preferably, the host cell is an eukaryotic cell, preferably a yeast cell, e.g. a cell of a strain of baker's yeast, or is an animal cell. More preferably, the host cell is an insect cell or a mammalian cell, in particular a human, mouse or rat cell. Most preferably, the host cell is a human cell. The term "suitable host cell" as used herein relates to a cell capable of facilitating lytic replication of EBV, leading to the production of EB-VLPs. Preferably, said cell is a mammalian cell, more preferably a primate cell, even more preferably a human cell. Most preferably, the suitable host cell is a 293HEK cell. It is also envisaged by the current invention that the suitable host cell may provide certain factors essential for lytic replication of EBV. E.g. where an EBV genome lacking a functional BZLF1 gene is used, which causes the virus to be unable to enter the lytic cycle, such function may be provided by the host cell after an expression construct for said BZLF1 gene has been transfected into the cell.

The present invention also relates to a preparation according to the present invention, the polynucleotide according to the present invention, the vector according to the present invention, and/or the host cell according to the present invention for use in medicine, in particular for use in vaccination of a subject.

As used herein, the terms "vaccination" and "vaccinating" relate to administering the compounds as specified herein and eliciting an immune response, preferably against at least one infectious agent as specified elsewhere herein. Thus, vaccination stimulates the immune system and establishes or improves immunity to infection with infectious agents, Preferably, vaccination according to the present invention allows for establishing or improving immunity to infection with an infectious agent, preferably EBV, or a cancer cell. It is to be understood that the vaccine according to the present invention may comprise further components, in particular as specified elsewhere herein. The skilled person will understand that vaccination may not elicit a significant immune response in all subjects vaccinated. Also, it is to be understood that vaccination may not be effective to prevent infection in all subjects vaccinated. However, the term requires that a, preferably statistically significant, portion of subjects of a cohort or population are effectively vaccinated.

Also, as indicated elsewhere herein, not every immunogenic peptide and/or vaccination polypeptide will have vaccinating activity in each subject; e.g. an immunogenic peptide restricted by a specific subtype of MHC molecule, may only be immunogenic in a subject having said MHC subtype, Thus, as used herein, the term immunogenic peptide relates to a peptide having the activity of inducing an immune response in a suitable subject. Preferably, vaccination is vaccination against EBV infection and/or against EBV-related disease, preferably is vaccination against EBV infection. As used herein, the term "EBV-related disease" relates to all disorders caused by the infection of a subject by EBV. In a preferred embodiment said EBV-related disease is infectious mononucleosis, Hodgkin's Lymphoma, Burkitt's Lymphoma, nasopharyngeal carcinoma, rheumatoid arthritis, multiple sclerosis, systemic lupus erythematosus, gastric carcinoma, or post-transplant lymphoproliferative disorder. The symptoms which characterize these diseases are well known in the art and are described in standard text books of medicine. Preferably, vaccination is vaccination against latent EBV infection and/or lytic EBV infection, preferably is vaccination against latent EBV infections and lytic EBV infection. Preferably, vaccination induces activation and/or proliferation of T-cells specific for the immunogenic peptide, more preferably of CD4+ T-cells and/or CD8+ T-cells specific for the immunogenic peptide, most preferably induces activation and/or proliferation of CD4+ T-cells specific for the immunogenic peptide.

Preferably, vaccinating is treating and/or preventing infection with an agent as specified herein or of diseases or symptoms associated therewith. The terms "treating" and "treatment" refer to an amelioration of the diseases or disorders referred to herein or the symptoms accompanied therewith to a significant extent. Said treating as used herein also includes an entire restoration of health with respect to the diseases or disorders referred to herein. It is to be understood that treating, as the term is used herein, may not be effective in all subjects to be treated. However, the term shall require that, preferably, a statistically significant portion of subjects suffering from a disease or disorder referred to herein can be successfully treated. Whether a portion is statistically significant can be determined without further ado by the person skilled in the art using various well known statistic evaluation tools, e.g., determination of confidence intervals, p-value determination, Student's t-test, Maim-Whitney test etc. Preferred confidence intervals are at least 90%, at least 95%, at least 97%, at least 98% or at least 99%. The p-values are, preferably, 0.1, 0.05, 0.01, 0.005, or 0.0001, Preferably, the treatment shall be effective for at least 10%, at least 20% at least 50% at least 60%, at least 70%, at least 80%, or at least 90% of the subjects of a given cohort or population. The term "preventing" and "prevention" refers to retaining health with respect to the diseases or disorders referred to herein for a certain period of time in a subject. It will be understood that the said period of time may be dependent on the amount of the drug compound which has been administered and individual factors of the subject discussed elsewhere in this specification. It is to be understood that prevention may not be effective in all subjects treated with the compound according to the present invention. However, the term requires that, preferably, a statistically significant portion of subjects of a cohort or population are effectively prevented from suffering from a disease or disorder referred to herein or its accompanying symptoms, Preferably, a cohort or population of subjects is envisaged in this context which normally, i.e. without preventive measures according to the present invention, would develop a disease or disorder as referred to herein. Whether a portion is statistically significant can be determined without further ado by the person skilled in the art using various well known statistic evaluation tools discussed herein above.

The term "subject" relates to a metazoan organism with the capacity to generate an immune response to molecules foreign to the organism. Preferably, the subject is an animal, more preferably a mammal, most preferably a human being. Preferably, the subject is suffering from immunodeficiency and/or is planned to undergo immunosuppressive treatment.

The present method also relates to a method for stimulating T-cells of a subject comprising contacting said subject with (i) a preparation according to the present invention, (ii) a polynucleotide according to the present invention, (iii) a vector according to the present invention, (iv) a host cell according to the present invention, or (v) any combination of (i) to (iv); thereby stimulating T-cells of said subject.

The method for stimulating T-cells of the present invention, preferably, is an in vivo method. However, the method may also be performed in vitro, e.g. on isolated cells, preferably peripheral blood mononuclear cells (PBMCs) or preparations of T-cells, Preferably, in case the method is an in vivo method, it is a method of vaccinating a subject. Moreover, the method may comprise steps in addition to those explicitly mentioned above. For example, further steps may relate, e.g., to diagnosing infection before the contacting step, or repeating said contacting. Moreover, one or more of said steps may be performed by automated equipment.

The present invention also relates to a kit comprising the preparation according to the present invention, the polynucleotide according to the present invention, the vector according to the present invention, and/or the host cell according to the present invention, comprised in a housing.

The term "kit", as used herein, refers to a collection of the aforementioned compounds, means or reagents of the present invention which may or may not be packaged together. The components of the kit may be comprised by separate vials (i.e. as a kit of separate parts) or provided in a single vial. Moreover, it is to be understood that the kit of the present invention, preferably, is to be used for practicing the methods referred to herein above. It is, preferably, envisaged that all components are provided in a ready-to-use manner for practicing the methods referred to above. Further, the kit, preferably, contains instructions for carrying out said methods. The instructions can be provided by a user's manual in paper or electronic form. In addition, the manual may comprise instructions for administration and/or dosage instructions for carrying out the aforementioned methods using the kit of the present invention. As will be understood from the above, the description of the kit comprising polynucleotides, preferably, relates to a kit comprising corresponding vectors mutatis mutandis.

Preferably, the kit comprises the preparation according to the present invention and at least one of a diluent, an adjuvant, and a means of administration. The term "adjuvant" is used herein in its usual meaning in the art. Appropriate diluents are described herein above, Means of administration are all means suitable for administering the preparation, the polynucleotide, the vector, and/or the host cell to a subject. The means of administration may include a delivery unit for the administration of the compound or composition and a storage unit for storing said compound or composition until administration. However, it is also contemplated that the means of the current invention may appear as separate devices in such an embodiment and are, preferably, packaged together in said kit, Preferred means for administration are those which can be applied without the particular knowledge of a specialized technician. In a preferred embodiment, the means for administration is a syringe, more preferably with a needle, comprising the compound or composition of the invention. In another preferred embodiment, the means for administration is an intravenous infusion (IV) equipment comprising the compound or composition. In still another preferred embodiment the means for administration is an inhaler comprising the compound of the present invention, wherein, more preferably, said compound is formulated for administration as an aerosol.

The present invention also relates to an EBV particle produced or producible from the polynucleotide of the present invention and/or the vector of the present invention. Preferably, the aforesaid EBV particle is an EB-VLP; also preferably, the EB particle is comprised in a preparation as specified elsewhere herein.

The present invention further relates to a use of a preparation according to the present invention, the polynucleotide according to the present invention, the vector according to according to the present invention, and/or the host cell according to the present invention for manufacturing a pharmaceutical composition, preferably a vaccine.

Also, the present invention relates to a method for manufacturing EB-VLPs comprising at least one vaccination polypeptide, said method comprising the steps of: a) culturing suitable host cells comprising the polynucleotide according to the present invention and/or the vector of the present invention; and b) obtaining EB-VIPs from said suitable host cells.

The method for manufacturing EB-VLPs, preferably, is an in vivo method and may comprise further steps, e.g. relating to obtaining EB-VIPs from the supernatant of the cultured suitable host cells.

Furthermore, the present invention relates to a method for the manufacture of a vaccine comprising the steps of the method for manufacturing EB-VLPs of the present invention and the further step of formulating the EB-VLPs as a vaccine.

In view of the above, the following embodiments are particularly envisaged:

1. A preparation comprising Epstein-Barr virus-like particles (EB-VLPs), said EB-VLPs being essentially free of Epstein Barr virus (EBV) DNA, wherein said EB-VLPs comprise a vaccination polypeptide comprising at least one peptide of an EBV tegument polypeptide and at least one immunogenic peptide.
2. The preparation of embodiment 1, wherein said at least one immunogenic peptide comprises at least one T-cell epitope
3. The preparation of embodiment 1 or 2, wherein said T-cell epitope is an MHC class II or MHC class I epitope, preferably an MHC class II epitope.
4. The preparation of any one of embodiments 1 to 3, wherein said at least one immunogenic peptide is an immunogenic peptide of a pathogenic microorganism, preferably of a virus, more preferably of a herpes virus.
5. The preparation of any one of embodiments 1 to 4, wherein said at least one immunogenic peptide is an immunogenic EBV peptide.
6. The preparation of any one of embodiments 1 to 5, wherein said at east one immunogenic peptide is an immunogenic peptide of a latent EBV polypeptide.
7. The preparation of any one of embodiments 1 to 6, wherein said at least one immunogenic peptide is an immunogenic peptide of a latent. EBV polypeptide comprising at least one T-cell epitope, preferably comprising at least one MHC class II epitope.
8. The preparation of embodiment 6 or 7, wherein said latent EBV polypeptide is selected from the list consisting of EBNA-1, EBNA-LP, EBNA-2, EBNA-3A, EBNA-3B, EBNA-3C, LMP-1, and LMP-2A; preferably is EBNA-1 and/or EBNA-3C.
9. The preparation of any one of embodiments 6 to 8, wherein said immunogenic peptide of a latent EBV polypeptide comprises, preferably consists of, the amino acid sequence of the EBNA1 3E10 epitope (NPKFENIAEGLRALL, SEQ ID NO:32), the EBNA 3G2 epitope (KTSLYNLRRGTALAI, SEQ ID NO:33), the EBNA3C 5H11 epitope (ENPYHARRGIKEHVI, SEQ ID NO:34), the EBNA-3C 3H10 epitope (VVRMFMRERQLPQS, SEQ ID NO:35) and/or a sequence of at least 7, preferably at least 8, more preferably at least 9, most preferably at least 10 amino acids of SEQ ID NO:36.
10. The preparation of any one of embodiments 1 to 9, wherein said vaccination polypeptide is a fusion polypeptide comprising said. EBV tegument polypeptide and said at least one immunogenic peptide.
11. The preparation of any one of embodiments 1 to 10, wherein said immunogenic peptide is fused to the N-terminus of said EBV tegument polypeptide, is fused to the C-terminus of said EBV tegument polypeptide, or is inserted into the amino acid sequence of said EBV tegument polypeptide.
12. The preparation of any one of embodiments 1 to 11, wherein said EBV tegument polypeptide is the EBV BNRF1 polypeptide.
13. The preparation of embodiment 12, wherein said immunogenic peptide is fused to the N-terminus of said BNRF1 polypeptide, is fused to the C-terminus of said BNRF1 polypeptide, or is inserted into the amino acid sequence of said BNRF1 polypeptide.
14. The preparation of embodiment 12 or 13, wherein said immunogenic peptide is inserted into said BNRF1 polypeptide at any one of positions 1 to 172 of the BNRF1 polypeptide and/or replaces amino acids within said positions.
15. The preparation of any one of embodiments 12 to 14, wherein said immunogenic peptide is inserted into said BNRF1 polypeptide at position 113.
16. The preparation of any one of embodiments 1 to 15, wherein said vaccination polypeptide comprises, preferably consists of, the amino acid sequence of SEQ ID NO:1, 2, or 3.
17. The preparation of any one of embodiments to 16, wherein said preparation is a pharmaceutical composition.
18. A polynucleotide encoding the vaccination polypeptide as specified in any one of embodiments 1 to 16.
19. The polynucleotide of embodiment 18, wherein said polynucleotide further encodes an EBV genome.
20. The polynucleotide of embodiment 19, wherein said EBV genome lacks EBV terminal repeat sequences and/or lacks at least one functionally expressible gene selected from the BFLF1 gene and the BBRF1 gene.
21. A vector comprising the polynucleotide according to any one of embodiments 18 to 20.
22. A host cell comprising the polynucleotide according to any one of embodiments 18 to 20 and/or the vector according to according to embodiment 21.
23. The preparation according to any one of embodiments 1 to 17, the polynucleotide according to any one of embodiments 18 to 20, the vector according to embodiment 21, and/or the host cell according to embodiment 22 for use in medicine.
24. The preparation according to any one of embodiments 1 to 17, the polynucleotide according to any one of embodiments 18 to 20, the vector according embodiment 21, and/or the host cell according to embodiment 22 for use in vaccination of a subject.
25. The preparation, the polynucleotide, the vector, and/or the host cell for use of embodiment 24, wherein said subject is suffering from immunodeficiency and/or is planned to undergo immunosuppressive treatment.
26. A method for stimulating T-cell of a subject comprising contacting said subject with
(i) a preparation according to any one of embodiments 1 to 17,
(ii) a polynucleotide according to any one of embodiments 18 to 20,
(iii) a vector according to according to embodiment 21,
(iv) a host cell according to embodiment 22, or
(v) any combination of (i) to (iv);
thereby vaccinating said subject.
27. The method of embodiment 26, wherein said vaccination is vaccination against EBV infection and/or against EBV-related disease, preferably is vaccination against post-transplant lymphoproliferative disorder.
28. The method of embodiment 26 or 27, wherein said vaccination is vaccination against latent EBV infection and/or lytic EBV infection, preferably is vaccination against latent EBV infections and lytic EBV infection.
29. A kit comprising the preparation according to any one of embodiments 1 to 17, the polynucleotide according to any one of embodiments 18 to 20, the vector according to according to embodiment 21, and/or the host cell according to embodiment 22, comprised in a housing.
30. The kit of embodiment 29, wherein said kit further comprises at least one of a diluent, an adjuvant, and a means of administration.
31. An EBV particle produced or producible from the polynucleotide of any one of embodiments 18 to 20 and/or the vector of embodiment 21.
32. Use of a preparation according to any one of embodiments 1 to 17, the polynucleotide according to any one of embodiments 18 to 20, the vector according to according to embodiment 21, and/or the host cell according to embodiment 22 for manufacturing a pharmaceutical composition, preferably a vaccine.
33. A method for manufacturing EB-VLPs comprising at least one vaccination polypeptide, said method comprising the steps of:
a) culturing suitable host cells comprising the polynucleotide according to any one of embodiments 18 to 20 and/or the vector of embodiment 21; and
b) obtaining EB-VLPs from said suitable host cells.
34. The method of embodiment 33, wherein said EB-VLPs are obtained from the supernatant of the cultured suitable host cells.
35. A method for the manufacture of a vaccine comprising the steps of the method of embodiment 33 or 34 and the further step of formulating the EB-VLPs as a vaccine.

All references cited in this specification are herewith incorporated by reference with respect to their entire disclosure content and the disclosure content specifically mentioned in this specification.

FIGURE LEGENDS

FIG. 1: The antigenic spectrum of EBV virions is enlarged through the construction of BNRF1-latent protein gene fusions. (A) EBV virions that encode a BNRF1-EBNA3C fusion protein stimulate BNRF1- and -EBNA3C specific CD4+ T cells. Autologous LCLs were pulsed with various amounts ($1\times10^4$ to $1\times10^6$ genome equivalents (geq)) of wtEBV or EBVE3C and then co-cultured with CD4+ T cells that were specific for BNRF1 VSD or EBNA3C 5H11 epitopes. In parallel, LCLs were pulsed with control peptides (μg to ng quantities) prior to co-culture with CD4+ T cells. T-cell activation was determined by measuring secreted IFN-γ by ELISA. (B) A neutralizing antibody that recognizes gp350 impairs the antigenicity of wtEBV and EBV-E3C. The neutralizing antibody 72A1 was titrated (50, 5 and 0 μg/mL) and incubated with $1\times10^6$ geq of wtEBV and EBV-E3C. Thereafter, supernatants were used in T-cell activation assays. The data displayed in each chart represents triplicate values and error bars represent standard deviation. Furthermore, each graph is a representative experiment of at least three.

Figure 2:
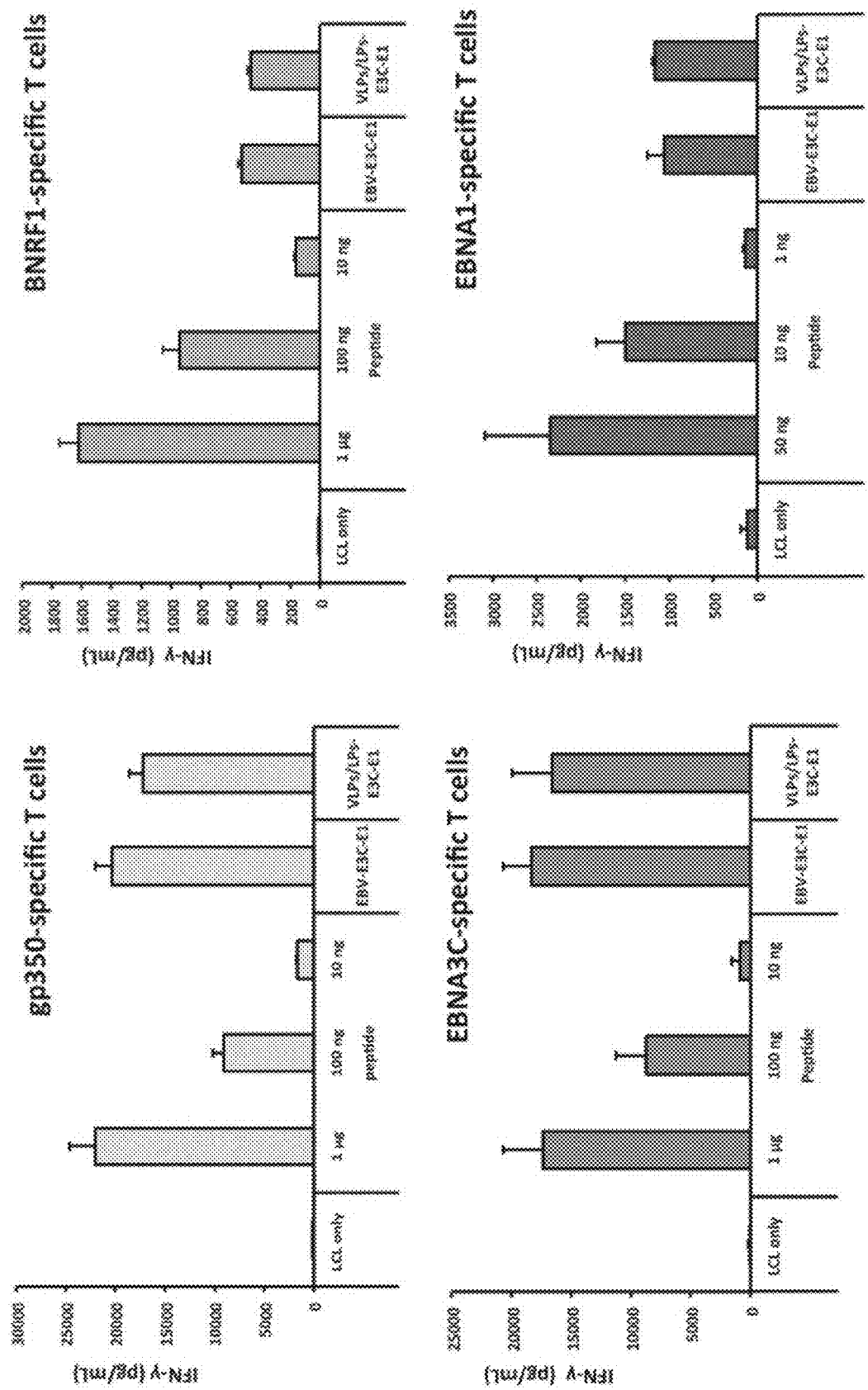

FIG. 2: Modified VLPs/LPs that lack gp1.10 are antigenic and stimulate multiple EBV-specific T cells. VLPs/LPs-E3C-E1 retain their antigenic character in the absence of gp110. Autologous LCLs were pulsed with control peptides, VLPs/LPs-E3C-E1 ($1\times10^6$ particles) or EBV-E3C-E1 ($1\times10^6$ geq) and cultured with T cells that were specific for gp350 1D6, BNRF1 VSD, EBNA3C 5H11 or EBNA1 3E10 epitopes. T-cell activity was determined by quantifying IFN-γ release with ELBA, The data illustrated in the graphs are average of triplicate values and error bars represent standard deviation. Furthermore, each graph is a representative experiment of at least three.

Figure 3:
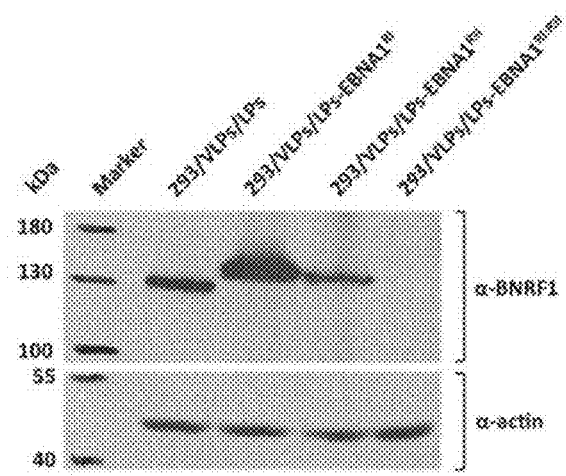
Figure 3:
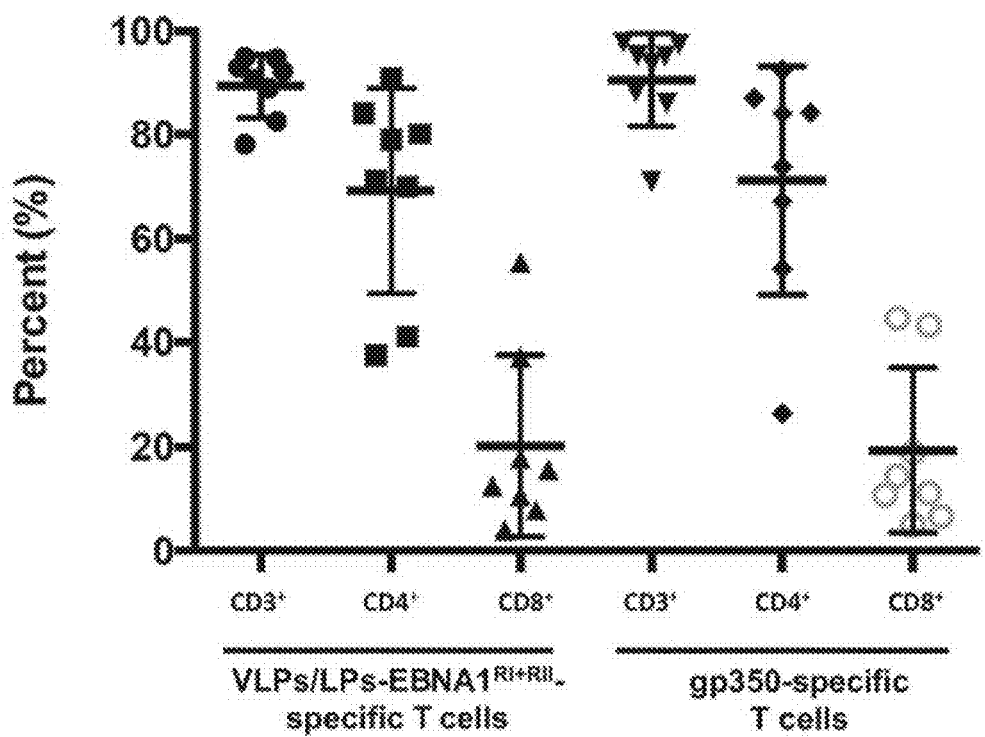
Figure 3:
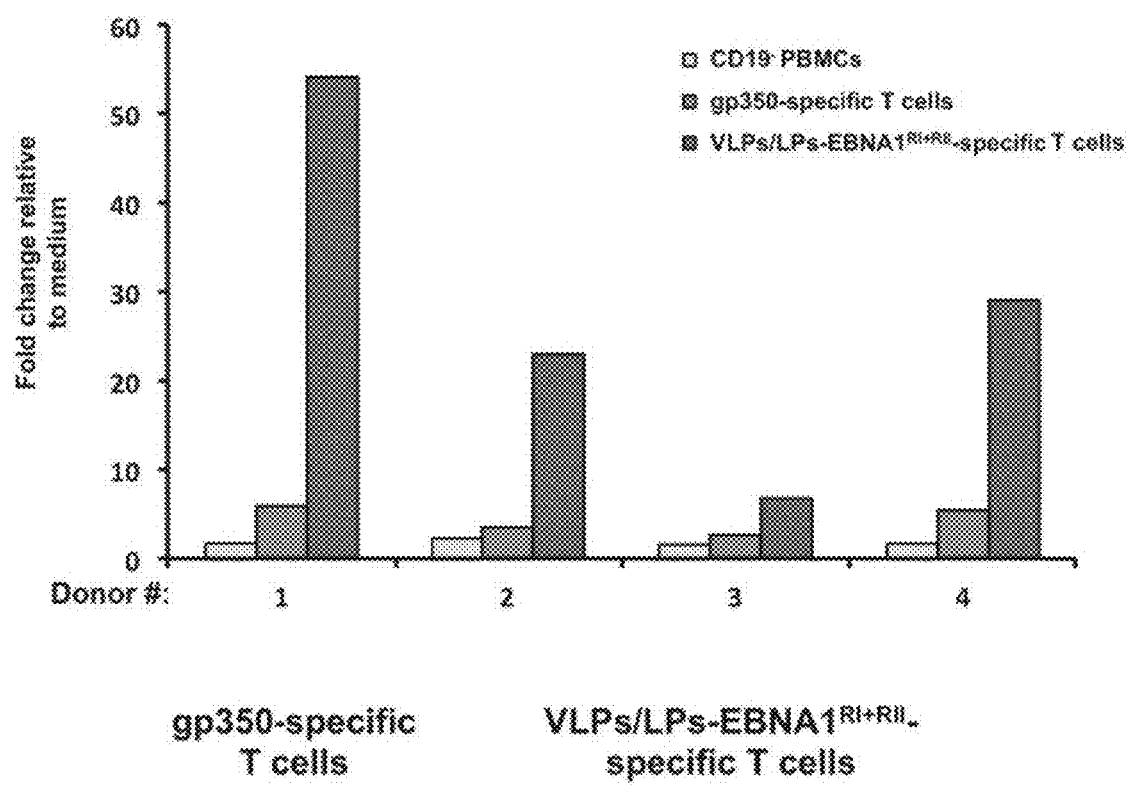

FIG. 3: VLPs/LPs containing EBNA1 fragments expand T cells that efficiently target EBV infected B cells. (A) Expression of BNRF1-EBNA1 fusion proteins by induced 293/VLPs/LPs-EBNA1RI, 293/VLPs/LPs-EBNA1RII and 293/VLPs/LPs-EBNA1RI:II producer cells. Western blot analysis was performed with α-BNRF1 and α-actin antibodies. (B) VLPs/LPs containing EBNA1 predominantly expand CD4+ T cells. VLPs/LPs-EBNA1RI and VLPs/LPs-EBNA1RII were combined in a 1:1 ratio (VLPs/LPs-EBNA1RI+RII) and used to stimulate PBMCs from eight unhaplotyped EBV-positive donors. The PBMCs from the same donors were stimulated in parallel with gp350-AgAb. Ex vivo cultures were stained for CD3, CD4 and CD8 after two stimulation cycles and analyzed with flow cytometry. The percentage of CD4+, CD8+ and total T cells (CD3+) in ex vivo cultures are shown. (C) VLPs/LPs-EBNA1RI+RII-specific T cells efficiently target EBV-infected B cells during the first 5 days of infection; a summary of flow cytometry results from four donors. PBMCs from four donors were stimulated as described in (B) and then co-cultured with B cells that were infected overnight with B95-8, Additionally, infected B cells were cultured in medium only or with CD19-depleted (CD19-) PBMCs, respectively serving as negative and positive controls for T-cell-mediated targeting of EBV-infected B cells. Ex vivo cultures were analysed five days post-infection with flow cytometry. For flow cytometry, cells were stained for CD19 and the percentage of CD19+ GFP+ double-positive B cells were quantified, Since the recombinant B95-8 strain encodes GFP, it enabled infected B cells to be identified through GFP expression. The percentage of CD19+GFP+ B cells in ex vivo cultures are expressed relative to that that of the medium only control.

Figure 4:
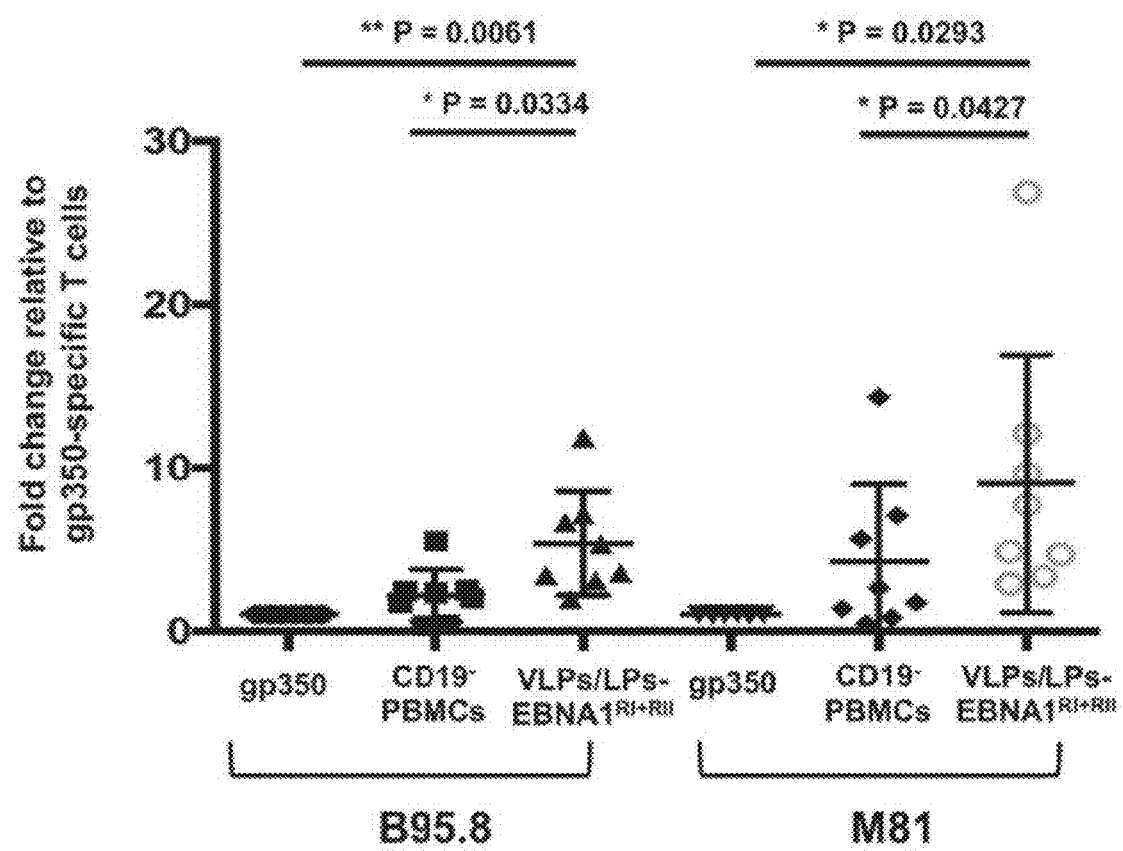
Figure 5:
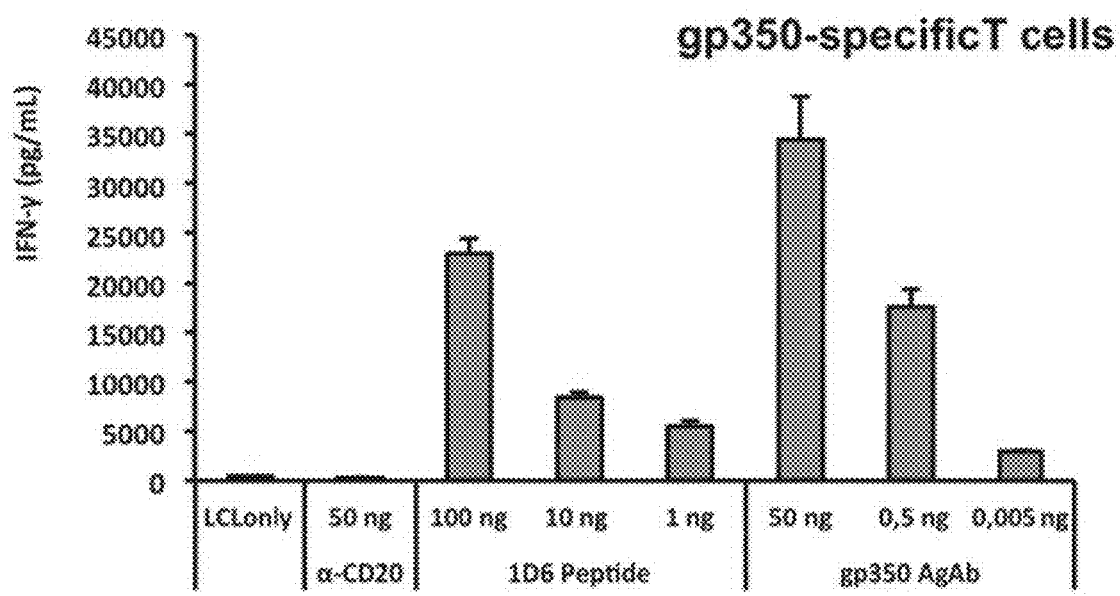
Figure 5:
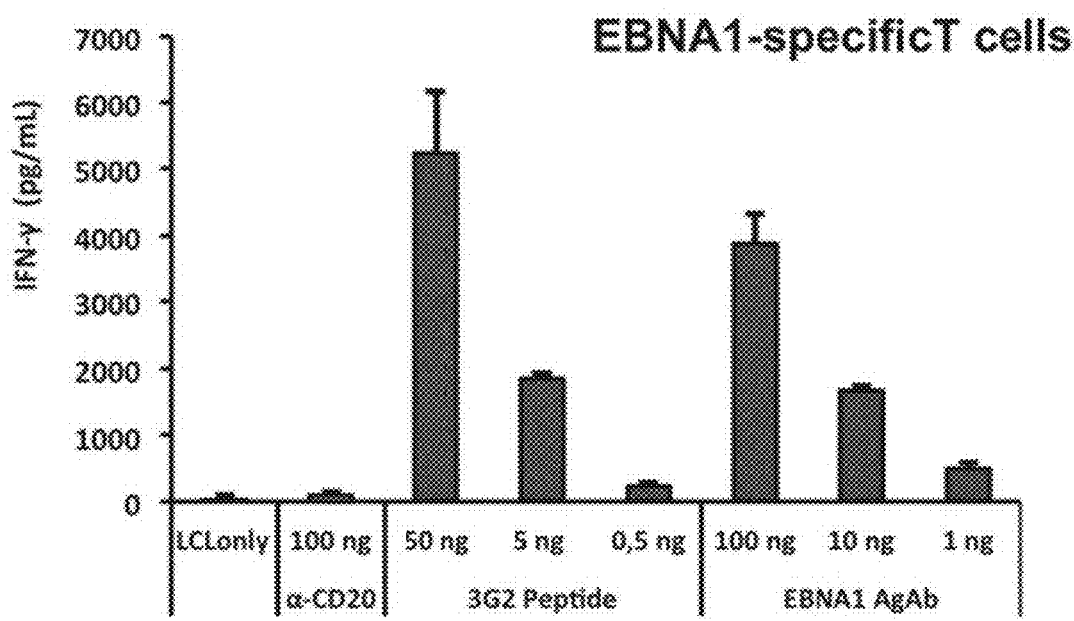
Figure 5:
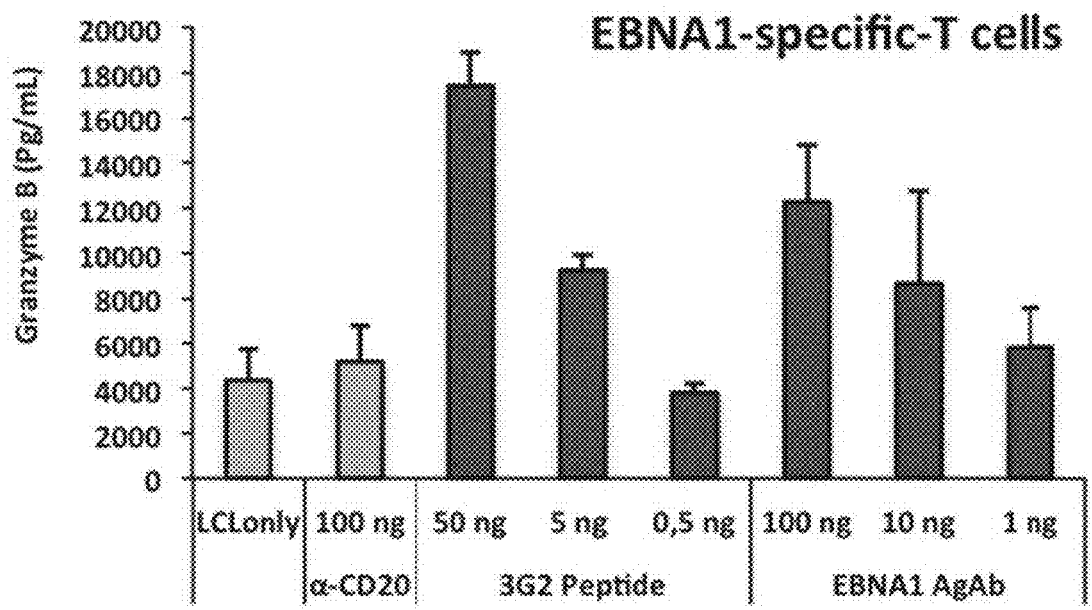
Figure 5:
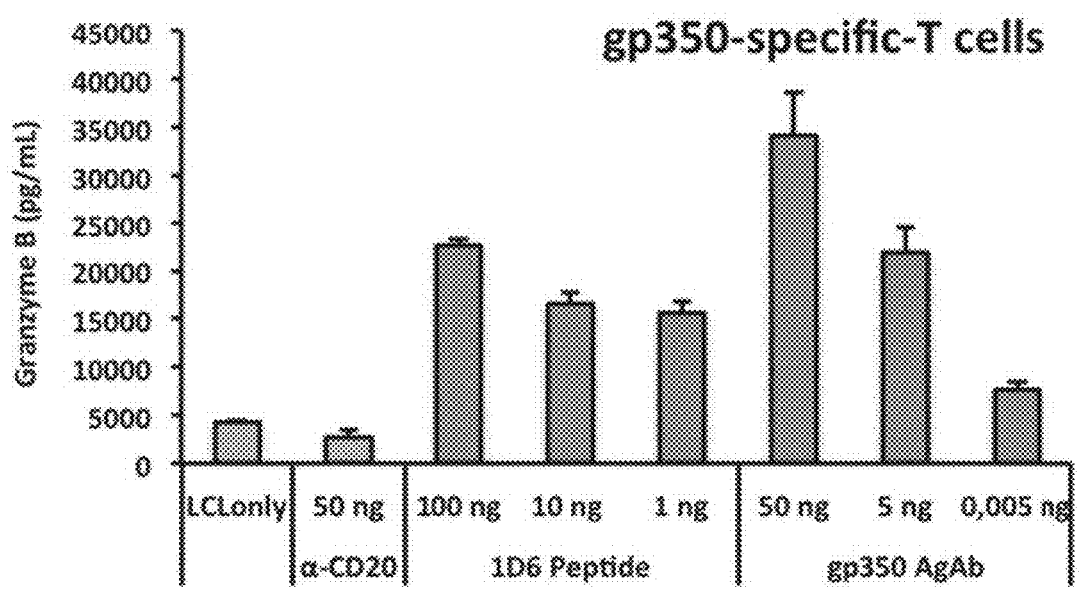
Figure 5:
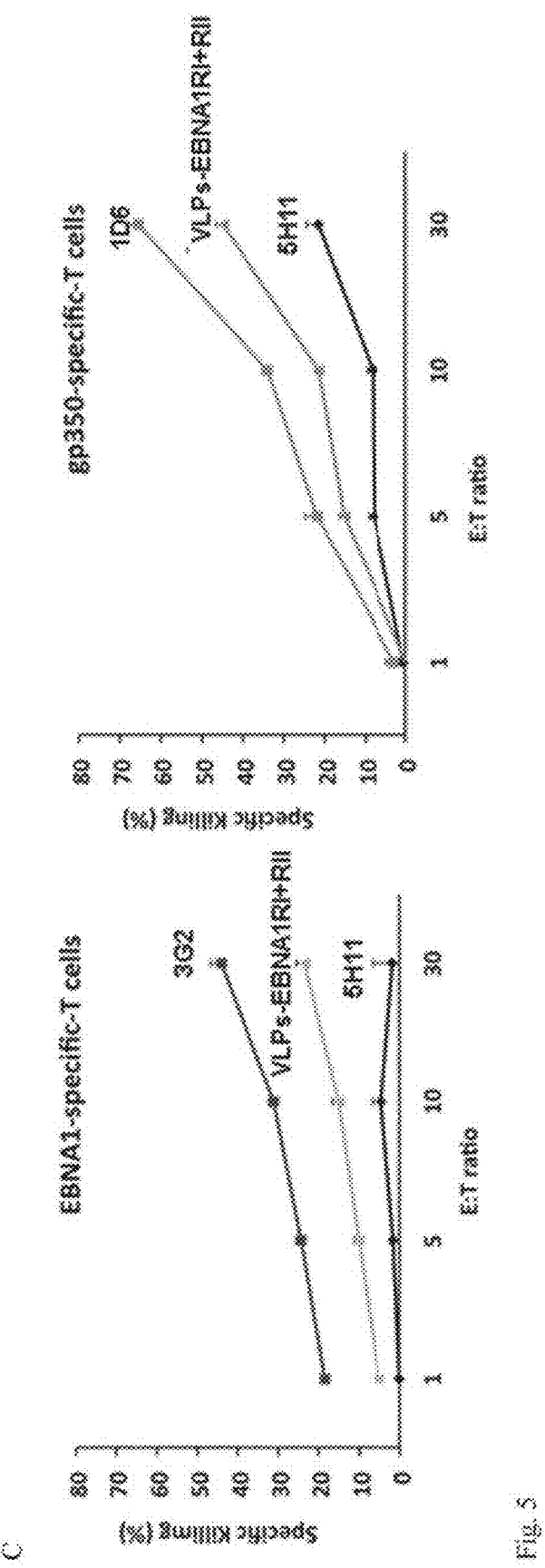

FIG. 4: VLPs/LPs-EBNA1RI-1-RII-specific T cells prevent the outgrowth of B95-8- and M81-infected B cells. T cells that recognize gp350 or VLPs/LPs-EBNA1RI+RII were expanded from the PBMCs of eight unhaplotyped EBV-positive donors as described in FIG. 3. Autologous primary B cells were infected overnight with B95-8 or M81 and then co-cultured with the stimulated PBMCs. In parallel, the infected B cells were cultured in medium only or with CD19- PBMCs. After 15 days, ex vivo cultures were stained for CD19 and CD23 and then analysed by flow cytometry. The Fig. shows summary of data obtained from eight donors. The percentage of CD19+CD23+ B cells in all cultures are expressed relative to the percentage of CD19+ CD23+ B cells in the presence of gp350-specific T cells. Statistical analysis was performed using a two-tailed student T-test. Only P values lower than 0.05 are shown, FIG. 5: VLPs/LPs containing EBNA1 enable the expansion of cytolytic gp3506 and EBNA1-specific CD4+ T cells. (A) The ex vivo expanded CD4+ T cells are specific for EBNA1 or gp350. Autologous LCLs were pulsed with EBNA1-AgAb, gp350-AgAb, EBNA1 3G2 epitope or gp350 1D6 epitope and then co-cultured with the CD4+ T cells. The release IFN-γ was quantified by ELISA. Each data point is the average of three values and error bars represents standard deviation. Each experiment is a representative of at least three. (B) EBNA1- and gp350-specific CD4+ T cells release granzyme B. Autologous LCLs were pulsed with EBNA1-AgAb, gp350-AgAb or relevant peptides (EBNA1 3G2 and gp350 1D6) and then cocultured with the CD4+ T cells. The release of granzyme B was quantified with an ELISA. The data displayed in each chart represent triplicate values and error bars represent standard deviation, Each graph is a representative experiment of at least three. (C) EBNA1- and gp350-specific CD4+ T cells lyse target cells pulsed with VLPs/LPs-EBNA1RI+RII. Autologous LCLs were pulsed overnight with VLPs/LPs-EBNA1RI+RII, EBNA1 3G2, gp350 1D6 or EBNA3C 5H11 (negative control) peptides. Thereafter, the pulsed LCLs were incubated with calcein AM and then cocultured with increasing amounts of the EBNA1- or gp350-specific CD4+ T cells. Effector to target (E.T) ratios of 1 to 30 were used. The release of calcein from targeted cells was measured at 535 nm after excitation with 485 nm light. Each data point is the average of three values and error bars represents error bars. Furthermore, each experiment is a representative of two experiments.

Figure 6:
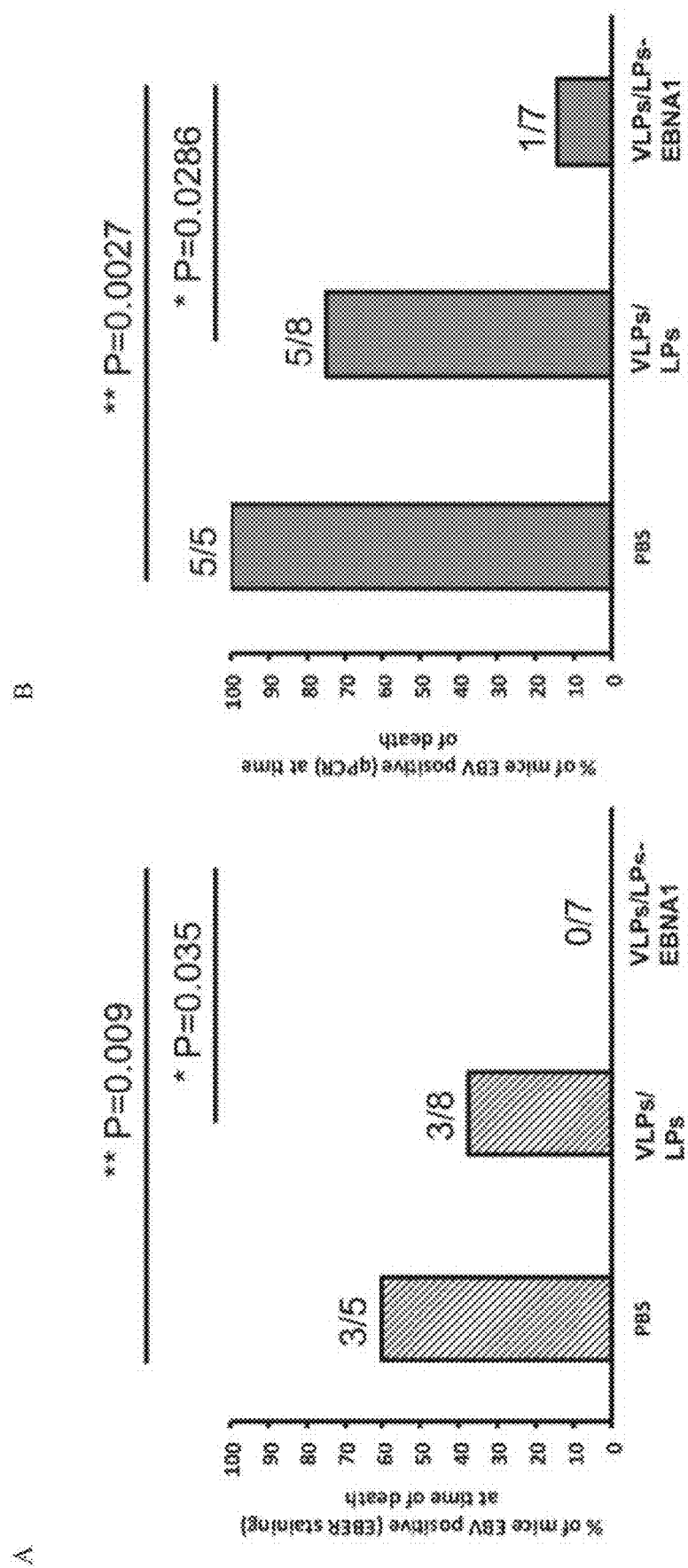

FIG. 6: Vaccination of humanized mice with VLPs/LPs-EBNA1RI+RII confers protective immunity. (A) Incidence of EBV infection based on EBER staining of spleens. B) Incidence of EBV-infection based on real-time qPCR analysis of peripheral blood. Statistical analysis was performed on the results shown using a one-tailed Chisquare test. Only P values lower than 0.05 are shown.

Figure 7:
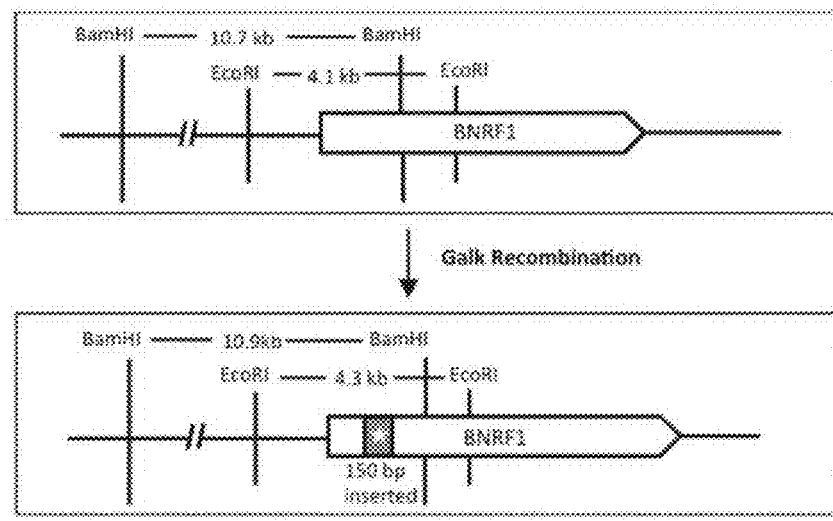
Figure 7:
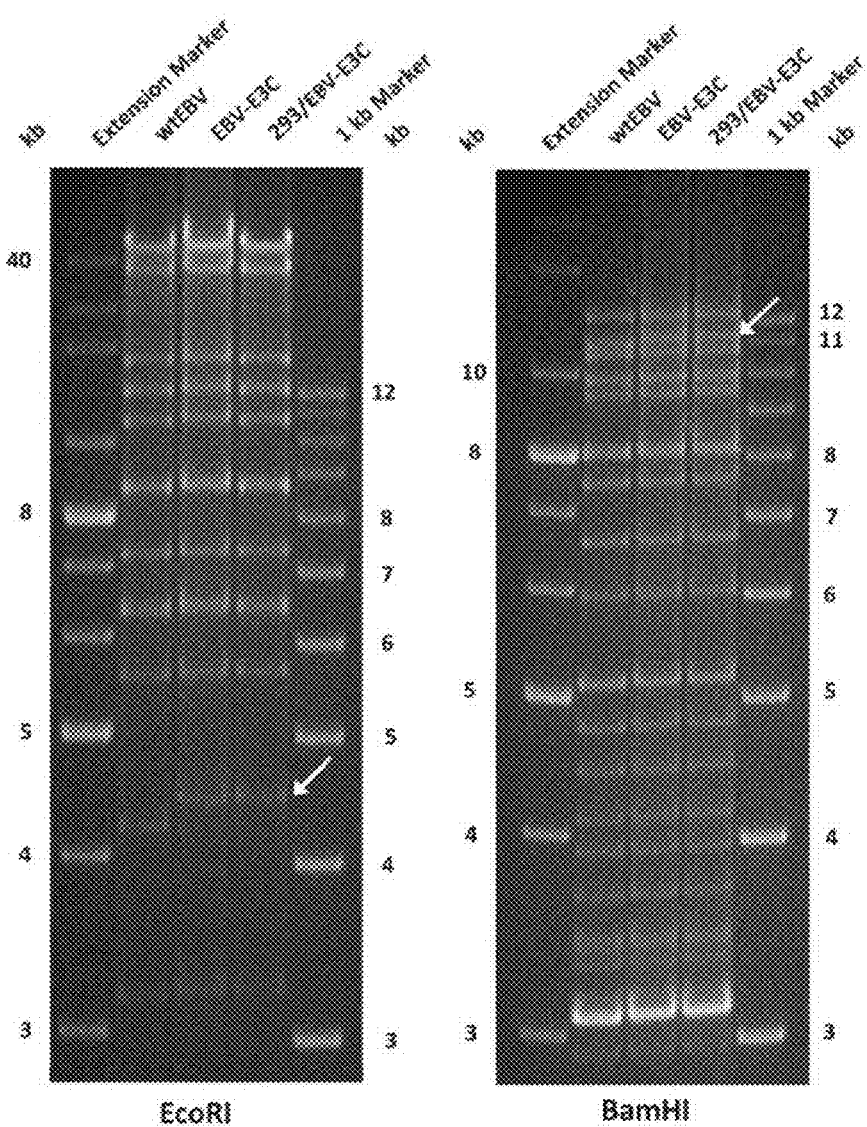

FIG. 7: Construction of EBV BAC DNA encoding a BNRF1-latent protein fusion. (A) Galk recombination was carried out with a 150 bp fragment encoding the EBNA3C (E3C) 5H11 epitope. EcoRI and BamHI restriction sites before and after recombination are shown, as are the size of fragments generated by these enzymes. (B) Restriction digestion with EcoRI and BamHI confirmed that EBV-E3C BAC DNA from 293 producer cells generated the same restriction fragments as EBV-E3C BAC DNA constructed in E. coli., White arrows emphasize DNA fragments that are different between wtEBV DNA (B95-8) and DNA modified with galK recombination. Construction and verification of the other constructs was performed analogously.

The following Examples shall merely illustrate the invention. They shall not be construed, whatsoever, to limit the scope of the invention.

EXAMPLE 1: MATERIALS AND METHODS

Ethics statement. Peripheral blood mononuclear cells (PBMCs) were isolated from healthy donors (ethical approval granted by the Ethikkommission der Medizinische Fakultät Heidelberg (S-603/2015)) or from anonymous buffy coats purchased from the Institut für Klinische Transfusionsmedizin und Zelltherapie (IKTZ) in. Heidelberg and did not require ethical approval. Animal experiments were approved (approval number G156-12) by the federal veterinary office at the Regierungspräsidium Karlsruhe (Germany) and were performed in strict accordance with German animal protection law (TierSchG). Mice were handled in accordance with good animal practice, as defined by the Federation of European Laboratory Animal Science Associations (FELASA) and the Society for Laboratory Animal Science (GVSOLAS), and were housed in the class II containment laboratory of the German Cancer Research Center.

Cell Lines and Primary Cells

Cell lines included EBV-positive Raji cells, EBV-negative Elijah B cells (kindly provided by Prof A. B. Rickinson), HEK293 cells, T cells specific for EBNA1 3E10, EBNA3C 5H11, gp350 1D6 and BNRF1 VSD epitopes and autologous LCLs (kindly provided by Prof. J. Mautner; produced essentially as described in Adhikary et al., 2007. PloS One. 2:e583 (BNRF1 VSD), Adhikary et al., J Virol 82:3903-3911(gp350 1D6), Yu et al., 2015, Blood 125: 1601-1610 (EBNA3C 5H11), Linnerbauer et al., PLoS Pathog 10: e10004068 (EBNA1 3E10). Peripheral blood mononuclear cells (PBMCs) were isolated using Ficoll-Paque Plus and primary B cells were isolated using Dynabeads CD19 Pan B (Invitrogen) and DETACHaBEAD CD19 kit (Invitrogen). RPMI containing 10% fetal calf serum was used to culture 293, Raji and Elijah cells. T-cell clones and lines were cultured as previously described by Adhikary et al. (2007), PLoS One 2: e583.

Construction and Production of AgAbs

AgAbs were constructed using sequences coding EBNA1 (390-622 aa) and gp350 (1-470 aa). Latent protein-coding sequences were PCR amplified and introduced downstream of an α-CD20 HC gene contained within the pRK5 expression vector (Yu et al. (2015), Blood 125: 1601). The α-CD20 antibody and AgAbs were produced by transfecting the appropriate heavy chains and the α-CD20 light chain into 293 cells using polyethyenimine (PEI). The following day the PEI-containing medium was removed and replaced with serum-free FreeStyle™ 293-expression medium and cells were incubated for three days. Supernatants were centrifuged at 400×g for 10 minutes and filtered through a 0.22 µm filter.

Recombinant BAC DNA and Stable Producer Cell Lines

Recombinant BAC DNA was constructed using galK recombination (Warming et al. (2005), Nucleic Acids Res 33: e36). In the present study, wtEBV (B95-8) or VLPs/LPs (B95-8ΔBFLF1/BFRF1a/BALF4) (Shumilov et al. (2017), Nat Commun 8: 14257) BAC DNA were modified to encode latent protein fragments. Only VLPs/LPs lacking BALF4, encoding the glycoprotein gp110, were utilized in the present study due to their enhanced safety. The primers used for the construction of BAC mutants, as well as a description of all BAC mutants, are shown in Table 1. The first step in galK recombination was the insertion of the galK cassette into the BNRF1 ORF of wtEBV or VLPs/LPs BAC DNA. Subsequently, the galK cassette was replaced with DNA fragments encoding latent protein moieties. Outgrowing colonies were analysed with restriction digestion and sequencing to confirm the integrity of BNRF1-latent protein fusions. Stable producer cells were generated with the recombinant BAC DNA as previously described Ganz et al. (2000), J Virol 74: 10142-40152).

Production of Virus and VLPs/LPs

An expression plasmid encoding BZLF1 (p509) was transfected into producer cells to induce virus or VLPs/LPs production. For the production of EBV (B95-8 or M81) for ex vivo and in vitro studies, the pRA plasmid encoding gp1.10 was cotransfected with p509 for increased infectivity. The liposome-based transfectant Metafectene (Biontex) was used to carry out transfections overnight. Subsequently, Metafectene-containing medium was removed and replaced with fresh medium. Transfected cells were incubated for three days before supernatants were harvested. Supernatants were centrifuged at 400×g for 10 minutes and filtered through a 0.44 µM filter. VLPs/LPs used for ex vivo T-cell expansions and animal experiments were produced in serum-free FreeStyle™ 293-expression medium (Gibco™). In all other cases, virus and VLPs/LPs were produced on RPMI supplemented with 10% FCS. Lastly, virus and VLPs/LPs used in animal experiments were concentrated at 18 000×g for 3 hours and resuspended in PBS.

Real-Time qPCR

Virus titers were determined by real-time qPCR as previously described (Pavlova et al. (2013), J Viral 87: 2011). In brief, virus containing supernatants were treated with DNase I (5 units) and proteinase K (1 mg/mL). Next, real-time qPCR analysis was carried out using primers and probe specific for the EBV BALF5 gene. To determine the presence of EBV in peripheral blood, genomic DNA from vaccinated and challenged animals was compared to unchallenged animals. Quantification of VLPs/LPs with flow cytometry wtEBV, previously quantified with real-time qPCR, was titrated (1, 0.75, 0.5, and 0.25×107 geq) and bound to Elijah B cells at 4° C. Cells were washed, stained with α-gp350 (clone 72A1) and α-mouse IgG-Cy3 antibodies and analysed with flow cytometry. MFI values were determined for different amounts of virus. A standard curve was generated for EBV genomes vs MFI. Concurrently, supernatants containing VLPs/LPs were incubated with Elijah B cells and stained as above. MEI values obtained for VLPs/LPs were extrapolated off the standard curve to quantify VLPs/LPs. T-cell activation assays IFN-γ in cell culture supernatants was determined as previously described (Yu et al. loc. cit.). Autologous LCLs were pulsed overnight with antigen and co-cultured for a minimum of 18 hours with T cells at an E:T ratio of 1:1. Supernatants were analyzed by ELISA (Mabtech). In blocking studies with neutralising antibody (72A1 clone), virus containing supernatants were preincubated with antibody for 1 hour at 37° C. before being used in T-cell activation assays. Short-term ex vivo stimulation of PBMCs with VLPs/LPs-EBNA1RI+RII or gp350-AgAb Bulk PBMCs from EBV-positive donors were pulsed with VLPs/LPs-EBNA1 (1×10$^6$ particles) or gp350-AgAb (20 ng). After two days, cultures were supplemented with IL-2 (10 U/mL) and thereafter maintained in medium containing IL-2. Cells were restimulated 10 days later using IL-2 (10 U/mL) and the same amount of VLPs/LPs-EBNA1 or gp350-AgAb. One week later, cells were analyzed for the presence of CD4, CD8 and CD3 expressing cells or where co-cultured with primary B cells that were infected overnight with EBV. Targeting of recently infected B cells by VLPs/LPs-EBNA1-stimulated PBMCs Bulk PBMCs from four EBV-positive donors were stimulated for two rounds with VLPs/LPs-EBNA1 (1×10$^6$ particles) or gp350-AgAb (20 ng) in the presence of IL-2 (10 U/mL). Autologous primary B cells were infected overnight with B95.8 (MOI=3) and then co-cultured with the stimulated PBMCs, CD19− depleted PBMCs or medium only. Ex vivo cultures were analyzed with flow cytometry and immunofluorescence 5 days post-infection to observe EBV-positive cells. Cells were stained with α-CD19-APC (HIB19 clone) prior to flow cytometry and α-CD20 (1.26 clone), α-EBNA2 (PE2 clone) and DAPI prior to immunofluorescence.

Restriction of B Cell Outgrowth by VLPs/LPs-EBNA1-Stimulated PBMCs

Bulk PBMCs from eight EBV-positive donors were stimulated for two rounds with VLPs/LPs-EBNA1 ($1 \times 10^6$ particles) or gp350-AgAb (20 ng) in the presence of IL-2 (10 U/mL). B cells were infected with B95-8 or M81, respectively using an MOI of 3 or 30 to account for their different transforming abilities. Ex vivo cultures stained with α-CD19-APC (H1B19 clone) and α-CD23-PE-Cy7 (EBVCS2 clone) antibodies and analysed by flow cytometry. Expansion of EBNA1 and gp350-specific CD4+ T cells from VLPs/LPs-EBNA1-stimulated. PBMCs PBMCs from an EBV-positive donor were stimulated for one round with VLPs/LPs-EBNA1RI+RII ($1 \times 10^6$ particles) in the absence of IL-2. After two weeks, cells were restimulated using irradiated (40 Gy) autologous PBMCs, pulsed with the same dose of VLPs/LPs-EBNA1RI+RII, in the presence of IL-2. After another two weeks, EBNA1- or gp350-specific T cells were expanded by stimulating cells biweekly with AgAbs (10-50 rig) that contained EBNA1 or gp350. Autologous LCLs, generated using B95-8ΔZR, were used as antigen presenting cells after the fifth round of stimulation. T cells were maintained in AIM V medium supplemented with 10% pooled human serum, IL-2 (10 U/mL), 10 mM HEPES, 2 mM L-glutamine, 50 µg/mL gentamicin and 0.4 mg/mL ciprofloxacin.

Generation, Vaccination and Challenge of Humanized NSG-A2 Mice

NSG-A2 mice (NOD.Cg-Prkdcscidl12rgtm1WjlTg (HLA-A2.1) 1Enge/SzJ) were humanized with CD34+ hematopoictic progenitor cells (HPCs) as previously described (Lin et al. (2015), PLoS Pathog 11: e1005344). Newborn mice were irradiated (1 Gy) and injected intrahepatically with CD34+ HPCs isolated from human fetal liver tissue (Advanced Bioscience Resources, USA). After 12 weeks, the presence of human CD45+ cells in the peripheral blood of mice was determined to confirm successful humanization. In total, 20 humanized NSG-A2 (huNSG-A2) mice were randomly grouped according to similarity of humanization ratios and injected intraperitoneally in a single blind fashion with PBS, VLPs/LPs ($1 \times 10^6$ particles) or VLPs/LPs-EBNA1 ($1 \times 10^6$ particles). In all cases, 50 µg poly (I:C) was used as adjuvant. Animals were boosted one month later with the same treatments. One and a half months after the boost, animals were injected intraperitoneally with $1 \times 10^5$ GRUB of B95-8. Mice were sacrificed eight weeks post-infection and their blood and tissues analysed for evidence of EBV infection. All the VLPs/LPs and virus used in animal experiments were obtained by centrifuging supernatants at 18 000×g for 3 hours and resuspending in PBS.

EXAMPLE 2: ENLARGING THE ANTIGENIC SPECTRUM OF EBV VIRIONS TO INCLUDE LATENT PROTEINS

To generate immunogenic particles with an enlarged antigenic spectrum, we fused antigens to BNRF1. However, since wild-type EBV (wtEB) can be accurately and sensitively quantified through qPCR, we first modified BNRF1 of wtEBV to test incorporation. The BNRF1 of wtEBV was modified to contain a fragment from the highly antigenic latent protein EBNA3C (FIG. 7). Bacterial artificial chromosome (BAC) DNA from wtEBV was modified to contain EBNA3C and then stably introduced into 293 cells to generate a virus producer cell line (293/EBV-E3C). The integrity of the EBV-E3C BAC DNA within producer cells was confirmed with restriction analysis (S1 Fig). Transfection of the lytic transactivator BZLF1 gene into 293/EBV-E3C and 293/wtEBV yielded a similar percentage of cells that expressed the late lytic protein gp350 (FIG. 7). This indicates that modification of BNRF1 to include a latent antigen does not influence lytic replication, Next, we compared the antigenicity of EBV-E3C and wtEBV viruses in T-cell activation assays (FIG. 1A). Autologous lymphoblastoid cell lines (LCLs) were pulsed with the two viruses or peptide controls and then cocultured with BNRF1- (Adhikary et al. (2007) loc. cit.) or EBNA3C- (Yu et al. (2015) loc. cit.) specific CD4+ T cells. This confirmed that virions were able to simulate EBNA3C- and BNRF1-specific CD4+ T cells when their BNRF1 was modified to contain an EBNA3C fragment. Conversely, wtEBV that contained unmodified BNRF1 was only able to stimulate the BNRF1-specific CD4+ T cells (FIG. 1A). In all cases, the dose of the virus applied correlated to the response generated by the T cells, with as little as $1\times10^4$ virions (genome equivalents (geq)) being able to generate responses from the BNRF1- and EBNA3C specific T cells. Importantly, BNRF1-specific CD4+ T cells recognized modified and unmodified EBV to the same extent. This indicates that BNRF1-latent antigen fusion proteins enlarged the antigenic spectrum of EBV without influencing the antigenicity of BNRF1. Next, we tested whether the enlarged antigenic spectrum of EBV-E3C was exclusively due to BNRF1-latent antigen fusions contained within virions. To this end, virus supernatants were preincubated with anti-gp350 neutralising antibody prior to being used in T-cell recognition assays (FIG. 1B). This showed that the neutralising antibody was able to abolish the antigenicity of EBV-E3C. Altogether, these results confirm that BNRF1-latent antigen fusion proteins are successfully packaged into virions and enlarge their antigenic spectrum.

EXAMPLE 3: ANTIGENIC DIVERSIFICATION OF VLP/LPS LACKING GP110

Next, we confirmed the antigenicity of BNRF1-latent antigen fusion proteins in gp110-negative VLPs/LPs. Since gp110 has been shown to preclude viral and host membrane fusion. (Neuhierl et al. (2009), J Viral. 83: 4616), and abrogate toxicity, we exclusively used gp110-negative VLPs/LPs in the present study, We concurrently modified VLPs/LPs and wtEBV to encode EBNA3C and EBNA1 fragments, respectively generating 293NLPs/LPs-E3C-E1 and 293/EBV-E3C-E1 producer cells. EBNA1, like EBNA3C, is a highly immunogenic latent protein that is frequently recognized by the population. The DNA-free VLPs/LPs-E3C-E1 were quantified using flow cytometry and then compared to an equivalent amount of EBV-E3C-E1 that was quantified with qPCR. This confirmed that flow cytometry enabled the reliable quantification DNA-free VLPs/LPs. Next, VLPs/LPs-E3C-E1 were analyzed in T-cell activation assays alongside EBV-E3C-E1 (FIG. 2). This showed that the VLPs/LPs, like EBV virions, were able to stimulate BNRF1-, gp350-, EBNA3C- and EBNA1-specific CD4+ T cells when they were modified to contain EBNA3C and EBNA1 fragments. Furthermore, the modified VLPs/LPs stimulated the various lytic protein- and latent protein-specific T cells to the same extent as modified EBV. This confirmed that VLPs/LPs could be used as a platform to generate immunogenic particles that comprise lytic and latent antigens. Furthermore, the lack of gp110 does not negatively influence the antigenicity of the VLPs/LPs, indicating that their safety can be increased without compromising their antigenicity.

EXAMPLE 4: MODIFIED VLPS/LPS EXPAND T CELLS THAT EFFICIENTLY TARGET RECENTLY INFECTED B CELLS

Since EBV-specific T cells play a crucial role in controlling EBV-infection, we tested whether modified VLPs/LPs could expand EBV-specific T cells with protective value. To this end, epitope-rich regions from EBNA1, arbitrarily named region I, region II and region I:II, were used to generate VLPs/LPs producer cells that encode EBNA1. Analysis of the producer cells with western blot showed that the 293/VLP/LP-EBNA1RI:II producer cell was unable to express the large BNRF1-EBNA1 fusion, whilst the 293/VLP/LP-EBNA1RI and 293/VLP/LP-EBNA1RII producer cells successfully their expressed their BNRF1-EBNA1 fusions (FIG. 3A). Hence VLPs/LPs-EBNA1RI:II were excluded form from analysis. VLPs/LPs-EBNA1RI and VLPs/LPs-EBNA1RII were combined (VLPs/LPs-EBNA1RI+RII) and used to stimulate bulk PBMCs from unhaplotyped EBV-positive donors (FIG. 3B). As a control, PBMCs from the same donors were also expanded with an antigen-armed antibody (AgAb) that contained the major EBV glycoprotein gp350. AgAbs were originally developed as a targeted therapy for B cell malignancies, but were repurposed in the present study to expand EBV-specific T cells of interest. Stimulation of PBMCs from EBV-positive donors with VLPs/LPs-EBNA1RI+RII or gp350-AgAb expanded similar numbers of CD4+, CD8+ and total T cells from the PBMCs of EBV-positive donors (FIG. 3B). Next, T cells expanded from the PBMCs of four EBV-positive donors were cocultured with B95-8-infected primary B cells. After 5 days, ex vivo cultures were analysed by flow cytometry to determine the presence of EBV-infected B cells (FIG. 3C). Since the recombinant B95-8 strain encodes GFP, it enabled infected B cells to be detected by identifying CD19+GFP+ double-positive cells. This showed that ex vivo cultures contained less CD19+GFP+ double-positive cells in the presence of gp350- and VLPs/LPs-EBNA1RI+RII-specific T cells compared to the control samples. This implies that both gp350- and VLPs/LPs-EBNA1RI+RII-specific T cells are capable of targeting EBV-infected B cells during the early phase of infection. However, results from four donors show that T cells specific for VLPs/LPs-EBNA1RI+RII were substantially more adept at targeting recently infected B cells than gp350-specific T cells (FIG. 3C). Ex vivo cultures contained very few EBNA2-positive B cells in the presence VLPs/LPs-EBNA1RI+RII-specific T cells. Taken together, these results indicate that modified VLPs/LPs are likely to generate superior protective T-cell responses compared to vaccines composed exclusively of gp350.

EXAMPLE 5: MODIFIED VLPS/LPS EXPAND T CELLS THAT RESTRICT THE OUTGROWTH OF B95-8- AND M81-INFECTED B CELLS

Having shown that VLP/LPs-EBNA1RI+RII-specific T cells efficiently targeted B95-8 infected. B cells, we tested whether they could prevent the outgrowth of infected B cells over a longer period. Additionally, we tested whether VLP/LPs-EBNA1RI+RII-specific T cells could prevent the outgrowth of B cells infected with the prototypic B95-8 strain or the distantly related M81 strain (Tsai et al. (2013), Cell Rep 5: 458.470) from. Hong Kong. We stimulated PBMCs from eight EBV-positive donors as before (see FIG. 3) and then cocultured them with B95-8- and M81-inflected. B cells. As a positive and negative control, infected B cells were respectively cultured with CD19-PBMCs or in medium only. After 15 days, ex vivo cultures were analysed with flow cytometry to detect outgrowing B cells (FIG. 4). Since proliferating B cells express CD23, outgrowing B cells were identified by detecting CD19+CD23+ double-positive cells. EBV-infected. B cells were found to consist of CD19+CD23−, CD19+CD23low and CD19+CD23high populations when they were cultured in medium only, with the majority of B cells being of the CD19+CD23high variety. Comparatively, in the presence of CD19− PBMCs, gp350-specific T cells and VLPs/LPs-EBNA1RI+RII-specific T cells, the number of CD19+CD23+ cells were considerably reduced. This indicated that proliferating B-cells were restricted in these cultures. Interestingly, whilst gp350-specific T cells were shown to be more efficient than. CD19− PBMCs at targeting infected B cells during the early phase of infection (see FIG. 3), the CD19− PBMCs of some donors were considerably more adept at restricting B-cell outgrowth than gp350-specific T cells (FIG. 4). This suggest that the PBMCs from some donors contained EBV-specific T cells, other than gp350-specific T cells, that were able to restrict B-cell outgrowth. However, it is evident that proliferating B cells were restricted to a greater degree in ex vivo cultures that contained VLPs/LPs-EBNA1RI+RII-specific T cells. Moreover, this was observed for B95-8- and M81-infected. B cells and for all donors (FIG. 4). This confirms that VLPs/LPs equipped with EBNA1 expand EBV-specific T cells that efficiently restrict B cells infected with B95-8 and M81 EBV.

EXAMPLE 6: MODIFIED VLPS/LPS STIMULATE CYTOLYTIC T CELLS THAT RECOGNIZE LYTIC AND LATENT CYCLE ANTIGENS

Having shown that VLPs/LPs-EBNA1RI+RII-specific T cells target and control EBV-infected cells, it indicated that they were cytolytic in character. To conclusively confirm that VLPs/LPs-EBNA1RI+RII stimulate cytolytic T cells, we expanded EBNA1- and gp350-specific T cells from VLPs/LPs-EBNA1RI+RII-stimulated PBMCs and analyzed them for their cytotoxic potential. Bulk PBMCs from an unhaplotyped EBV-positive donor was stimulated with VLPs/LPs-EBNA1RI+RII for a couple of rounds, after which gp350-AgAb or EBNA1-AgAb were used to expand gp350- and EBNA1-specific CD4+ T cells (FIG. 5A). The expanded CD4+ T cell were confirmed to be specific for either EBNA1 or gp350. The ex vivo expanded CD4+ T cells specifically responded to EBNA1-AgAb or gp350-AgAb and to EBNA1 3G2 or gp350 1D6 epitope peptides. Next, we determined whether the EBNA1- and gp350-specific CD4+ T cells were capable of expressing CD107a, a surrogate marker for the release of cytolytic granules. Autologous LCLs were pulsed with α-CD20, EBNA1-AgAb or gp350-AgAb then cocultured with the EBNA1- and gp350-specific CD4+ T cells. This showed that both CD4+ T-cell lines upregulated CD107a in response to the relevant antigen. However, approximately 50% of gp350-specific CD4+ T cells expressed CD107a, whilst only 10% of EBNA1-specific CD4+ T cells expressed. CD1.07a. Next, we tested the ability of EBNA1- and gp350-specific CD4+ T cells to release the mediator of cytolysis granzyme B (FIG. 5B). Both the EBNA1- and gp350-specific CD4+ T cells released granzyme B in response to the relevant AgAb and epitope peptide, Lastly, we tested whether the EBNA1- and gp350-specific CD4+ T cells were capable of directly lysing autologous LCLs pulsed with antigen (FIG. 5C). This showed that the both the EBNA1- and gp350-specific CD4+ T cells specifically lysed LCLs pulsed with epitope peptides and VLPs/LPs that contained. EBNA1. Taken together, these results confirm that VLPs/LPs-EBNA1RI+RII have the ability to stimulate cytolytic CD44+ T cells specific for lytic and latent antigens. These results are consistent with previous studies that showed EBNA1- and gp350-specific T cells to be cytolytic.

EXAMPLE 7: VACCINATION WITH EBV VLPS/LPS CONTAINING EBNA1 PROTECTS ICE FROM WTEBV INFECTION

Having shown that modified VLPs/LPs were antigenic in vitro and ex vivo, we assesses whether VLPs/LPs-EBNA1RI+RII had protective abilities in vivo. To this end, mice reconstituted with human immune system components, susceptible to EBV infection and capable of exerting EBV-specific immune control, were used to interrogate VLPs/LPs-EBNA1RI+RII. Humanized NSG A2 (huNSG-A2) mice were randomly grouped and injected intraperitoneally with PBS, unmodified VLPs/LPs ($1\times10^6$ particles) or VLPs/LPs-EBNA1RI+RII ($1\times10^6$ particles), using poly (I:C) as an adjuvant. Four weeks later, mice were boosted using the same dose. Animals were challenged with B95-8 ($1\times10^5$ GRUs) six weeks after the last boost and euthanized eight weeks later. From the literature we knew that this titer would enable infection without gross development of tumors. The spleens of challenged animals were analysed by histology. This showed that all animals contained human CD20- and CD3-positive cells in their spleens. However, there was no correlation between the abundance of CD20- and CD3-positive cells and the different treatments. In situ hybridization revealed the presence of interspersed cells that expressed EBV-encoded RNAs (EBERs) in the spleens of mice from the PBS and unmodified VLPs/LPs groups. In total, 60% of mice from the PBS group were found to contain EBER+ cells, while 37.5% of the mice from the VLPs/LPs group contained EBER+ cells (FIG. 6A). Statistical analysis showed that this observation was statistically insignificant (P>0.05). None of the spleen samples from the VLPs/LPs-EBNA1RI+RII group were found to contain EBER+ cells. This result was confirmed to be statistically significant from the PBS (P=0.009) and VLPs/LPs (P=0.035) groups. Next, qPCR was used to detect the presence of EBV in the peripheral blood of challenged animals (FIG. 6B). This showed that 100% of mice from the PBS group contained EBV DNA in their peripheral blood, compared to 62% of the VLPs/LPs group and 14% of the VLPs/LPs-ERNA1RI+RII group. Once more, statistical analysis revealed that the observed difference between the PBS and VLPs/LPs group was not significant (P>0.05). However, statistical analysis showed that the difference between the VLPs/LPs-EBNA1RI+RII group and the PBS (P=0.0017) and VLPs/LPs (P=0.0286) groups was significant. These results indicate that the inclusion of EBNA1 within VLPs/LPs significantly improved vaccine-induced immunity, which bodes well for future investigations that involve VLPs/LPs containing antigenic fragments from multiple immunodominant latent proteins.

LITERATURE

Adhikary et al. (2007), PLoS One 2: e583
Adhikary et al. (2008), J Virol 82:3903
Bernardeau et al., (2011), J Immunol Methods, 371(1-2):97
Bordner (2010), PLoS ONE 5(12): e14383
Greenstone et. al. (1998), Proc. Natl. Acad. Sci. USA 95:1800
Fearon et al. (2000), Annu Rev Immunol 18:393
Janz et al. (2000), J Virol 74: 10142-10152
Johannsen et al. (2004), Proc Natl Acad Sci USA 101: 16286
Kieff and Rickinson. (2006), hi D. M. Knipe and P. M. Howley (ed.), Fields virology, 5th ed. Lippincott-Raven, Philadelphia, Pa.: 2603
Kieff and Rickinson, (2006), In D. M. Knipe and P. M. Howley (ed.), Fields virology, 5th ed. Lippincott-Raven, Philadelphia, Pa.: 2655
Linnerbauer et al. (2014), PLoS Pathog 10: e10004068
Küppers, R. (2003), Nat. Rev. Immunol. 3:801-812
Laichalk and Thorley-Lawson. (2005), J. Virol. 79:1296
Lin et al. (2015), PLoS Pathog 11: e1005344
Long et al. (2011), Curr Opin Immunol 23(2):258
Mandic and Vujkov. (2004), Ann. Oncol. 15:197
Neuhierl et al. (2009), J Virol 83: 4616
Nielsen et al., (2004), Bioinformatics, 20 (9), 1388
Pavlova et al. (2013), J Virol 87: 2011
Rees et al. (2009), Transplantation 88(8):1025
Rooney et al., (1998), Blood 92:1549-1555
Ruiss et al. ((2011), J Virol 85(24):13105)
Shumilov et al. (2017), Nat Commun 8: 14257
Tsai et al. (2013), Cell Rep 5: 458-470
Warming et al. (2005), Nucleic Acids Res 33: e36
WO 2013/098364
Yu et al. (2015), Blood 125: 1601

| Primer | Sequence | Clone | SEQ ID NO: |
| --- | --- | --- | --- |
| EBNA1for | TAGCGGCCGCACAGTCACATCATCCGGGTCTC | EBNA1-AgAb | 12 |
| EBNA1rev | TTTCATAGATCTTAATGGTGATGGTGATGATGCGCGGCAGCCCCTTCC | | 13 |
| gp350 for | CGTAGCGGCCGCAATGGAGGCAGCCTTGCTTG | gp350-AgAb | 14 |
| gp350 rev | TTTCATAGATCTTAATGGTGATGGTGATGATGGGTGGATACAGTGGGGCCTG | | 15 |
| GalKfwd | GAGCAGGGTGAACACTTGGGCACGGAGAGTGCCCTGGAGGCCTCAGGCAACCTGTTGACAATTAATCATCGGCA | EBV-galK | 16 |
| Galkrev | ATGTGGAAGGCCTTGCCATCCAGTCTGGTCCGTAGGCATACACATAGTTGTCAGCACTGTCCTGCTCCTT | | 17 |

-continued

| Primer | Sequence | Clone | SEQ ID NO: |
|---|---|---|---|
| GalKfwd2 | GAGCAGGGTGAACACTTGGGCACGGAGAGTGCCCTGGAGGC CTCAGGCAACCTGTTGACAAATTAATCATCGGCA | VLPs/LPs-galK | 18 |
| GalKrev2 | ATGTGGAAGGCCTTGCCATCCAGTCTGGTCCGTAGGCATACA CATAGTTGTCAGCACTGTCCTGCTCCTT | | 19 |
| E3Cfwd | GAGCAGGGTGAACACTTGGGCACGGAGAGTGCCCTGGAGGC CTCAGGCAATGCACCACCTAATGAAAATCCATATCAC | EBV-E3C | 20 |
| E3Crev | ATGTGGAAGGCCTTGCCATCCAGTCTGGTCCGTAGGCATACA CATAGTTGCCTGACGCAGGTTTACGGC | | 21 |
| E1-E3fwd | AGCAGGGTGAACACTTGGGCACGGAGAGTGCCCTGGAGGCCT CAGGCAACAATGCACCACCTAATGAAAATCC | EBV-E3C-E1 | 22 |
| E1-E3Crev | CATGTGGAAGGCCTTGCCATCCAGTCTGGTCCGTAGGCATAC ACATAGTTTCCAGGGGCCATTCCAAAG | | 23 |
| E1-E3fwd2 | AGCAGGGTGAACACTTGGGCACGGAGAGTGCCCTGGAGGCCT CAGGCAAGAATGCACCACCTAATGAAAATCC | VLPs/LPs-E3C-E1 | 24 |
| E1-E3Crev2 | CATGTGGAAGGCCTTGCCATCCAGTCTGGTCCGTAGGCATAC ACATAGTTTCCAGGGGCCATTCCAAAG | | 25 |
| E1RIfwd | TAATCCCTCAGGCCAGTCATCATCCGGGTCTCCAC | VLPs/LPs-EBNA1RI | 26 |
| E1RIrev | TTAGATCCTGAGGCACTACCTCCATATACGAACACACCGGC | | 27 |
| E1RIIfwd | GGCACTACCGACGAAGGAACTTGGGTCG | VLPs/LPs-EBNA1RII | 28 |
| E1RIIrev | GGCCGCGGCAGCCCCTTCCAC | | 29 |
| E1RI:IIfwd | GGCACTACCGACGAAGGAACTTGGGTCG | VLPs/LPs-EBNA1RI:RII | 30 |
| E1RI:IIrev | GGCCGCGGCAGCCCCTTCCAC | | 31 |

SEQUENCE LISTING (210 sequences)

SEQ ID NO: 1 - protein, 1448 aa, Artificial
  BNRF1-EBNA1(387-513aa)
MEERGRETQMPVARYGGPFIMVRLFGQDGEANIQEERLYELLSDPRSALGLDPGPLIAENLLLVALRGTNNDPRPQRQERARELALVGILLGNGEQGEHLGTESALEASGQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSASGNNYVYAYGPDWMARPSTWSAEIQQFLRLLGATYVLRVEMGRQFGFEVHRSRPSFRQFQAINHLVLFDNALRKYDSGQVAAGFQRALLVAGPETADTRPDLRKLNEWVFGGRAAGGRQLADELKIVSALRDTYSGHLVLQPTETLDTWKVLSRDTRTAHSLEHGFIHAAGTIQANCPQLFMRRQHPGLFPFVNAIASSLGWYYQTATGPGADARAAARRQQAFQTRAAAECHAKSGVPVVAGFYRTINATLKGGEGLQPTMFNGELGAIKHQALDTVRYDYGHYLIMLGPFQPWSGLTAPPCPYAESSWAQAAVQTALELFSALYPAPCISGYARPPGPSAVIEHLGSLVPKGGLLLFLSHLPDDVKDGLGEMGPARATGPGMQQFVSSYFLNPACSNVFITVRQRGEKINGRTVLQALGRACDMAGCQHYVLGSTVPLGGLNFVNDLASPVSTAEMMDDFSPFFTVEFPPIQEEGASSPVPLDVDESMDISPSYELPWLSLESCLTSILSHPTVGSKEHLVRHTDRVSGGRVAQQPGVGPLDLPLADYAFVAHSQVWTRPGGAPPLPYRTWDRMTEKLLVSAKPGGENVKVSGTVITLGEQGYKVSLDLREGTRLAMAEALLNAACAPILDPEDVLLTLHLHLDPRRADNSAVMEAMTAASDYARGLGVKLTFGSASCPETGSSASNFMTVVASVSAPGEFSGPLITPVLQKTGSLLIAVRCGDGKIQGGSLFEQLFSDVATTPRAPEALSLKNLFRAVQQLVKSGIVLSGHDISDGGLVTCLVEMALAGQRGVTITMPVASDYLPEMFAEHPGLVFEVEERSVGEVLQTLRSMNMYPAVLGRVGEQGPDQMFEVQHGPETVLRQSLRLLLGTWSSFASEQYECLRPDRINRSMHVSDYGYNEALAVSPLTGKNLSPRRLVTEPDPRCQVAVLCAPGTRGHESLLAAFTNAGCLCRRVFFREVRDNTFLDKYVGLAIGGVHGARDSALAGRATVALINRFPALRDAILKFLNRPDTFSVALGELGVQVLAGLGAVGSTDNPPAPGVEVNVQRSPLILAPNASGMFESRWLNISIPATTSSVMLRGLRGCVLPCWVQGSCLGLQFTNLGMPYVLQNAHQIACHFHSNGTDAWRFAMNYPRNPTEQGNIAGLCSRDGRHLALLCDPSLCTDFWQWEHIPPAFGHPTGCSPWTLMFQAAHLWSLRHGRPSE

SEQ ID NO: 2 - protein, 1444 aa, Artificial
  BNRF1-EBNA1 (497-619aa)
MEERGRETQMPVARYGGPFIMVRLFGQDGEANIQEERLYELLSDPRSALGLDPGPLIAENLLLVALRGTNNDPRPQRQERARELALVGILLGNGEQGEHLGTESALEASGTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAASGNNYVYAYGPDWMARPSTWSAEIQQFLRLLGATYVLRVEMGRQFGFEVHRSRPSFRQFQAINHLVLFDNALRKYDSGQVAAGFQRALLVAGPETADTRPDLRKLNEWVFGGRAAGGRQLADELKIVSALRDTYSGHLVLQPTETLDTWKVLSRDTRTAHSLEHGFIHAAGTIQANCPQLFMRRQHPGLFPFVNAIASSLGWYYQTATGPGADARAAARRQQAFQTRAAAECHAKSGVPVVAGFYRTINATLKGGEGLQPTMFNGELGAIKHQALDTVRYDYGHYLIMLGPFQPWSGLTAPPCPYAESSWAQAAVQTALELFSALYPAPCISGYARPPGPSAVIEHLGSLVPKGGLLLFLSHLPDDVKDGLGEMGPARATGPGMQQFVSSYFLNPACSNVFITVRQRGEKINGRTVLQALGRACDMAGCQHYVLGSTVPLGGLNFVNDLASPVSTAEMMDDFSPFFTVEFPPIQEEGASSPVPLDVDESMDISPSYELPWLSLESCLTSILSHPTVGSKEHLVRHTDRVSGGRVAQQPGVGPLDLPLADYAFVAHSQVWTRPGGAPPLPYRTWDRMTEKLLVSAKPGGENVKVSGTVITLGEQGYKVSLDLREGTRLAMAEALLNAACAPILDPEDVLLTLHLHLDPRRADNSAVMEAMTAASDYARGLGVKLTFGSASCPETGSSASNFMTVVASVSAPGEFSGPLITPVLQKTGSLLIAVRCGDGKIQGGSLFEQLFSDVATTPRAPEALSLKNLFRAVQQLVKSGIVLSGHDISDGGLVTCLVEMALAGQRGVTITMPVASDYLPEMFAEHPGLVFEVEERSVGEVLQTLRSMNMYPAVLGRVGEQGPDQMFEVQHGPETVLRQSLRLLLGTWSSFASEQYECLRPDRINRSMHVSDYGYNEALAVSPLTGKNLSPRRLVTEPDPRCQVAVLCAPGTRGHESLLAAFTNAGCLCRRVFFREVRDNTFLDKYVGLAIGGVHGARDSALAGRATVALINRFPALRDAILKFLNRPDTFSVALGELGVQVLAGLGAVGSTDNPPAPGVEVNVQRSPLILAPNASGMFESRWLNISIPATTSSVMLRGLRGCVLPCWVQGSCLGLQFTNLGMPYVLQNAHQIACHFHSNGTDAWRFAMNYPRNPTEQGNIAGLCSRDGRHLALLCDPSLCTDFWQWEHIPPAFGHPTGCSPWTLMFQAAHLWSLRHGRPSE

SEQ ID NO: 3 - protein, 1428 aa, Artificial
  BNRF-EBNA3C-EBNA1 fusion
MEERGRETQMPVARYGGPFIMVRLFGQDGEANIQEERLYELLSDPRSALGLDPGPLIAENLLLVALRGTNNDPRPQRQERARELALVGILLGNGEQGEHLGTESALEASGNNAPPNENPYHARRGIKEHVIQNAFRASGIMAPPVVRMFMRERQLPQSTGRKPASGPKFENIAEGLRALLARSHVERTTDEGTWVARGTALAIPQCRLTPLSRLPFGMAPGNYVYAYGPDWMARPSTWSAEIQQFLRLLGATYVLRVEMGRQFGFEVHRSRPSFRQFQAINHLVLFDNALRKYDSGQVAAGFQRALLVAGPETADTRPDLRKLNEWVFGGRAAGGRQLADELKIVSALRDTYSGHLVLQPTETLDTWKVLSRDTRTAHSLEHGFIHAAGTIQANCPQLFMRRQHPGLFPFVNAIASSLGWYYQTATGPGADARAAARRQQAFQTRAAAECHAKSGVPVVAGFYRTINATLKGGEGLQPTMFNGELGAIKHQALDTVRYDYGHYLIMLGPFQPWSGLTAPPCPYAESSWAQAAVQTALELFSALYPAPCISGYARPPGPSAVIEHLGSLVPKGGLLLFLSHLPDDVKDGLGEMGPARATGPGMQQFVSSYFLNPACSNVFITVRQRGEKINGRTVLQALGRACDMAGCQHYVLGSTVPLGGLNFVNDLASPVSTAEMMDDFSPFFTVEFPPIQEEGASSPVPLDVDESMDISPSYELPWLSLESCLTSILSHPTVGSKEHLVRHTDRVSGGRVAQQPGVGPLDLPLADYAFVAHSQVWTRPGGAPPLPYRTWDRMTEKLLVSAKPGGENVKVSGTVITLGEQGYKVSLDLREGTRLAMAEALLNAACAPILDPEDVLLTLHLHLDPRRADNSAVMEAMTAASDYARGLGVKLTFGSASCPETGSSASNFMTVVASVSAPGEFSGPLITPVLQKTGSLLIAVRCGDGKIQGGSLFEQLFSDVATTPRAPEALSLKNLFRAVQQLVKSGIVLSGHDISDGGLVTCLVEMALAGQRGVTITMPVASDYLPEMFAEHPGLVFEVEERSVGEVLQTLRSMNMYPAVLGRVGEQGPDQMFEVQHGPETVLRQSLRLLLGTWSSFASEQYECLRPDRINRSMHVSDYGYNEALAVSPLTGKNLSPRRLVTEPDPRCQVAVLCAPGTRGHESLLAAFTNAGCLCRRVFFREVRDNTFLDKYVGLAIGGVHGARDSALAGRATVALINRFPALRDAILKFLNRPDTFSVALGELGVQVLAGLGAVGSTDNPPAPGVEVNVQRSPLILAPNASGMFESRWLNISIPATTSSVMLRGLRGCVLPCWVQGSCLGLQFTNLGMPYVLQNAHQIACHFHSNGTDAWRFAMNYPRNPTEQGNIAGLCSRDGRHLALLCDPSLCTDFWQWEHIPPAFGHPTGCSPWTLMFQAAHLWSLRHGRPSE

SEQ ID NO: 4 - DNA, 4344 bp, Artificial
  BNRF1-EBNA1 (387-513aa) encoding
atggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggccagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtgcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgag

SEQ ID NO: 5 - DNA, 4332 bp, Artificial
  BNRF1-EBNA1 (497-619aa) encoding
atggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgag

SEQ ID NO: 6 - DNA, 4284 bp, Artificial
  BNRF-EBNA3C-EBNA1 fusion encoding
atggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaatgcaccacctaatgaaaatccatatcacgcgcggagaggcataaaagaacacgtaatccagaacgcatttcgagcgtcaggcataatggcgcctcccgtcgtacgtatgtttatgagggagcgacagctcccccagtccaccggccgtaaacctgcgtcaggcccgaaatttgagaacattgcagaaggtttaagagctctcctggctaggagtcacgtagaaaggactaccgacgaaggaacttgggtcgcccgaggaacagcccttgctattccacaatgtcgtcttacaccattgagtcgtctcccctttggaatggcccctggaaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgag

SEQ ID NO: 7 - DNA, 182566 bp, Artificial
  EBV genome producing VLPs and BNRF1-EBNA1 (387-513aa)
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggccagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtgcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcggcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatcgcgtgtttagattggagtgaacgccgtttccatttaggtgggtacgttggagccgcattattttcgctttatgaatctaaagggtggttaactcgacatcttggttaccgtgaagttaccatcacggaaaaaggttatgctgcttttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaatgaatagttcgacaaagatcgcattggtaattacgttactcgatgccatggggattggccttatcatgccagtcttgccaacgttattacgtgaatttattgcttcggaagatatcgctaaccactttggcgtattgcttgcactttatgcgttaatgcaggttatctttgctccttggcttggaaaaatgtctgaccgatttggtcggcgcccagtgctgttgttgtcattaataggcgcatcgctggattacttattgctggctttttcaagtgcgctttggatgctgtatttaggccgtttgctttcagggatcacaggagctactggggctgtcgcggcatcggtcattgccgataccacctcagcttctcaacgcgtgaagtggttcggttggttaggggcaagttttgggcttggtttaatagcggggcctattattggtggttttgcaggagagatttcaccgcatagtcccttttttatcgctgcgttgctaaatattgtcactttccttgtggttatgttttggttccgtgaaaccaaaaatacacgtgataatacagataccgaagtaggggttgagacgcaatcgaattcggtatacatcactttatttaaaacgatgcccattttgttgattatttatttttcagcgcaattgataggccaaattcccgcaacggtgtgggtgctatttaccgaaaatcgttttggatggaatagcatgatggttggcttttcattagcgggtcttggtcttttacactcagtattccaagcctttgtggcaggaagaatagccactaaatggggcgaaaaaacggcagtactgctcgaatttattgcagatagtagtgcatttgcctttttagcgtttatatctgaaggttggttagatttccctgttttaattttattggctggtggtgggatcgctttacctgcattacagggagtgatgtctatccaaacaaagagtcatgagcaaggtgctttacagggattattggtgagccttaccaatgcaaccggtgttattggcccattactgtttactgttatttataatcattcactaccaatttgggatggctggatttggattattggtttagcgttttactgtattattatcctgctatcgatgaccttcatgttaacccctcaagctcaggggagtaaacaggagacaagtgcttagttatttcgtcaccaaatgatgttattccgcgctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 8 - DNA, 182554 bp, Artificial
  EBV genome producing VLPs and BNRF1-EBNA1 (497-619aa)
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcggcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatcgcgtgtttagattggagtgaacgccgtttccatttaggtgggtacgttggagccgcattattttcgctttatgaatctaaagggtggttaactcgacatcttggttaccgtgaagttaccatcacggaaaaaggttatgctgcttttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaatgaatagttcgacaaagatcgcattggtaattacgttactcgatgccatggggattggccttatcatgccagtcttgccaacgttattacgtgaatttattgcttcggaagatatcgctaaccactttggcgtattgcttgcactttatgcgttaatgcaggttatctttgctccttggcttggaaaaatgtctgaccgatttggtcggcgcccagtgctgttgttgtcattaataggcgcatcgctggattacttattgctggctttttcaagtgcgctttggatgctgtatttaggccgtttgctttcagggatcacaggagctactggggctgtcgcggcatcggtcattgccgataccacctcagcttctcaacgcgtgaagtggttcggttggttaggggcaagttttgggcttggtttaatagcggggcctattattggtggttttgcaggagagatttcaccgcatagtcccttttttatcgctgcgttgctaaatattgtcactttccttgtggttatgttttggttccgtgaaaccaaaaatacacgtgataatacagataccgaagtaggggttgagacgcaatcgaattcggtatacatcactttatttaaaacgatgcccattttgttgattatttatttttcagcgcaattgataggccaaattcccgcaacggtgtgggtgctatttaccgaaaatcgttttggatggaatagcatgatggttggcttttcattagcgggtcttggtcttttacactcagtattccaagcctttgtggcaggaagaatagccactaaatggggcgaaaaaacggcagtactgctcgaatttattgcagatagtagtgcatttgcctttttagcgtttatatctgaaggttggttagatttccctgttttaattttattggctggtggtgggatcgctttacctgcattacagggagtgatgtctatccaaacaaagagtcatgagcaaggtgctttacagggattattggtgagccttaccaatgcaaccggtgttattggcccattactgtttactgttatttataatcattcactaccaatttgggatggctggatttggattattggtttagcgttttactgtattattatcctgctatcgatgaccttcatgttaacccctcaagctcaggggagtaaacaggagacaagtgcttagttatttcgtcaccaaatgatgttattccgcgctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 9 - DNA, 182506 bp, Artificial
  EBV genome producing VLPs and BNRF1-EBNA3C-EBNA1
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaatgcaccacctaatgaaaatccatatcacgcgcggagaggcataaaagaacacgtaatccagaacgcatttcgagcgtcaggcataatggcgcctcccgtcgtacgtatgtttatgagggagcgacagctcccccagtccaccggccgtaaacctgcgtcaggcccgaaatttgagaacattgcagaaggtttaagagctctcctggctaggagtcacgtagaaaggactaccgacgaaggaacttgggtcgcccgaggaacagcccttgctattccacaatgtcgtcttacaccattgagtcgtctcccctttggaatggcccctggaaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcggcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatcgcgtgtttagattggagtgaacgccgtttccatttaggtgggtacgttggagccgcattattttcgctttatgaatctaaagggtggttaactcgacatcttggttaccgtgaagttaccatcacggaaaaaggttatgctgcttttaagacccactttcacatttaagttgtttttctaatccgcatatgatcaattcaaggccgaataagaaggctggctctgcaccttggtgatcaaataattcgatagcttgtcgtaataatggcggcatactatcagtagtaggtgtttccctttcttctttagcgacttgatgctcttgatcttccaatacgcaacctaaagtaaaatgccccacagcgctgagtgcatataatgcattctctagtgaaaaaccttgttggcataaaaaggctaattgattttcgagagtttcatactgtttttctgtaggccgtgtacctaaatgtacttttgctccatcgcgatgacttagtaaagcacatctaaaacttttagcgttattacgtaaaaaatcttgccagctttccccttctaaagggcaaaagtgagtatggtgcctatctaacatctcaatggctaaggcgtcgagcaaagcccgcttattttttacatgccaatacaatgtaggctgctctacacctagcttctgggcgagtttacgggttgttaaaccttcgattccgacctcattaagcagctctaatgcgctgttaatcactttacttttatctaatctagacatcattaattcctaatttttgttgacactctatcattgatagagttattttaccactccctatcagtgatagagaaaagtgaaatgaatagttcgacaaagatcgcattggtaattacgttactcgatgccatggggattggccttatcatgccagtcttgccaacgttattacgtgaatttattgcttcggaagatatcgctaaccactttggcgtattgcttgcactttatgcgttaatgcaggttatctttgctccttggcttggaaaaatgtctgaccgatttggtcggcgcccagtgctgttgttgtcattaataggcgcatcgctggattacttattgctggctttttcaagtgcgctttggatgctgtatttaggccgtttgctttcagggatcacaggagctactggggctgtcgcggcatcggtcattgccgataccacctcagcttctcaacgcgtgaagtggttcggttggttaggggcaagttttgggcttggtttaatagcggggcctattattggtggttttgcaggagagatttcaccgcatagtcccttttttatcgctgcgttgctaaatattgtcactttccttgtggttatgttttggttccgtgaaaccaaaaatacacgtgataatacagataccgaagtaggggttgagacgcaatcgaattcggtatacatcactttatttaaaacgatgcccattttgttgattatttatttttcagcgcaattgataggccaaattcccgcaacggtgtgggtgctatttaccgaaaatcgttttggatggaatagcatgatggttggcttttcattagcgggtcttggtcttttacactcagtattccaagcctttgtggcaggaagaatagccactaaatggggcgaaaaaacggcagtactgctcgaatttattgcagatagtagtgcatttgcctttttagcgtttatatctgaaggttggttagatttccctgttttaattttattggctggtggtgggatcgctttacctgcattacagggagtgatgtctatccaaacaaagagtcatgagcaaggtgctttacagggattattggtgagccttaccaatgcaaccggtgttattggcccattactgtttactgttatttataatcattcactaccaatttgggatggctggatttggattattggtttagcgttttactgtattattatcctgctatcgatgaccttcatgttaacccctcaagctcaggggagtaaacaggagacaagtgcttagttatttcgtcaccaaatgatgttattccgcgctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 10 - DNA, 181778 bp, Artificial
  BFLF1 KO Genome
agaattcgtcttgctctattcacccttacttttcttcttgcccgttctctttcttagtatgaatccagtatgcctgcctgtaattgttgcgccctacctcttttggctggcggctattgccgcctcgtgtttcacggcctcagttagtaccgttgtgaccgccaccggcttggccctctcacttctactcttggcagcagtggccagctcatatgccgctgcacaaaggaaactgctgacaccggtgacagtgcttactgcggttgtcacttgtgagtacacacgcaccatttacaatgcatgatgttcgtgagattgatctgtctctaacagttcacttcctctgcttttctcctcagtctttgcaatttgcctaacatggaggattgaggacccaccttttaattctcttctgtttgcattgctggccgcagctggcggactacaaggcatttacggttagtgtgcctctgttatgaaatgcaggtttgacttcatatgtatgccttggcatgacgtcaactttacttttatttcagttctggtgatgcttgtgctcctgatactagcgtacagaaggagatggcgccgtttgactgtttgtggcggcatcatgtttttggcatgtgtacttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaagatccttctggcacgactgttcctatatgctctcgcactcttgttgctagcctccgcgctaatcgctggtggcagtattttgcaaacaaacttcaagagtttaagcagcactgaatttatacccagtgagtatctatttgttactcctgtttagttgaagaaaacaagctattggattgtaacacacattttacgctttgttccttagatttgttctgcatgttattactgattgtcgctggcatactcttcattcttgctatcctgaccgaatggggcagtggaaatagaacatacggtccagtttttatgtgcctcggtggcctgctcaccatggtagccggcgctgtgtggctgacggtgatgtctaacacgcttttgtctgcctggattcttacagcaggattcctgattttcctcattggtaagtgtgacaccaacaggtgttgccttgttatgtcaccgttctgacacatgacttacatgggtttggcttttgtaggctttgccctctttggggtcattagatgctgccgctactgctgctactactgccttacactggaaagtgaggagcgcccaccgaccccatatcgcaacactgtataaaggtaagtattattaaattttagagacactatcacgtgtaacttgacgtgcaaggatggaagagaggggcagggaaacgcaaatgccggttgcccggtatgggggcccgtttattatggtaaggctcttcgggcaagatggagaggcaaacatacaggaggaaaggctatatgagctactctctgacccacgctccgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagttccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcggagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccaacttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcacccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctgctgggaacctggtcatcctttgccagcgagcagtacgagtgcctgcgaccagatcggattaaccggtccatgcacgtgtccgactacggctataacgaagcactggcagtctccccgttgacaggaaagaatctcagcccacgccggttggtgacagagcctgacccacgatgtcaggtggccgtgctatgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgtttccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatgttttgcagaatgcccaccagatcgcctgccacttccacagcaatggcacggatgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtccccctagccccgggcccagccctcctcagaaaactctgcatggagaagctggacgtgaacctcccccccagacctgtgtgctgtatttacaaacactacaataaacccaatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcactacagaagtgtaagcaaagtgaagggctcggaaggcaggcggggcctagcaatgtcacagctaaatgcccaccagggcacacactcaagcggggtctcggagctcctaggtcagaccacgaaaggtcagcctgcaaggtggatggcgtgttttctgaggttatccccgctacgtgcagtgctgggtgatagagaccctagaatgtgtcgaaatgaccaagcgtccccgcagcggggctcccaacacgggttcccagagagggtaaaagagggggccataaagcccagggtgtaaaacaccgaccgcgccaccagatggcacacgtgggggaaatgagggttagcataggcaacccccgcctacacaccaactatagcaaaccccgccccgtcacggtgacgtagtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaacttttgttttaggatttatgcatccattatcccgcagttccacctaaacggggcttaacgttgcatcccagaagatgcacgcttaaccccgcctacaaccgtgacgtagctgtttaccagcatgtatagagttacggttcgctacatcaaacaggacagccgttgccctagtggtttcggacacaccgccaacgctcagtgcggtgctaccgacccgaggtcaagtcccgggggaggagaagagaggcttcccgcctagagcatttgcaagtcaggattctctaatccctctgggagaagggtattcggcttgtccgctatttttttgtggctagttttgcacccacaacatgtaagggcccgctacccctacaacacaaaacaaactatctcccctaaccatccttttgccaatcaattctgtgacagggtttcctggacacccagtcttagttcaggtagacacccagttatgcagtgccaccaattccaaccatttttaaacctcctggaattctatcattaaacggcatgcaggaaaaggacaagcagcgaaaattcacgcccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatggcaacattagcccaccgtgctctcagcgacctcgtgaatatgaggaccaacaaccctgtgcttggcgctcaggcgcaagtgtgtgtaatttgtcctccagatcgcagcaatcgcgcccctatcttggcccgcccacctacttatgcaggtattccccggggtgccattagtggttttgtgggcaagtggtttgaccgcagtggttagcggggttacaatcagccaagttattacacccttattttacagtccaaaaccgcagggcggcgtgtgggggctgacgcgtgcccccactccacaatttcaaaaaaaagagtggccacttgtctttgtttatgggccccattggcgtggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccatagccataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgtccaaattttattctgggggcgtcacctgaaaccttgttttcgagcacctcacatacaccttactgttcacaactcagcagttattctattagctaaacgaaggagaatgaagaagcaggcgaagattcaggagagttcactgcccgctccttgatcttcagccactgcccttgtgactaaaatggttcactaccctcgtggaatcctgaccccatgtaaataaaaccgtgacagctcatggggtgggagatatcgctgttccttaggacccttttactaaccctaattcgatagcatatgcttcccgttgggtaacatatgctattgaattagggttagtctggatagtatatactactacccgggaagcatatgctacccgtttagggttaacaagggggccttataaacactattgctaatgccctcttgagggtccgcttatcggtagctacacaggcccctctgattgacgttggtgtagcctcccgtagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcacttccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtcaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcctcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaagatgcgaaactacaggcccgggcccaggccttgcagggcagacggttaggctgacaaggggacaagtgtggcaggtgggcgggaaggggcacaagaatgccggcgaaactggaccacggtccaccccgccctcaagcgtccgggagccgggcggctcggctaaggagggcggccttgcgaacaattattagtagctaccaacaagggcccccagatgccccccaccagtcacccggccgtgtccactcacatattccactcttatttttaaattaatgtgtcccaattagaaacccaagcgcagaaattagttgagaggctagtgttttaaacatgcaccctaggccagccagagataatgtcacaagattatcaagttggtgtaaacacgccgtgggaaaaaatttatggttcagtgcgtcgagtgctatctttggaacagtagaaaattgaaccttgttggcgggagaaggaataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttctgctgcaaattttagatcagatggcatagagacaaggacaccgaagacccccagagccctcatcgcagggttcttaccatgcggccatgtaggcccacttaacactacaagacctacgcctctccattcatcatgtaacccacaaatcatctaaaccgtaagtctaagggcctcctgaggttttctcaggaggccctaatgtataattaatcatgcatttgattttaaaaaagtaggttacactcattttaggccagactttatttgcagattaataatttatgtgattctccttccctctaggactgaagaaacagcctcctgcacgtgagcatgtatctgaaataattattatgtcataagtgtaatgattagaaagtcataaacccacttccctttacatgaatctgggcactgaattttggggtacttctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatgtaattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgttcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctcccgcccctgtccactgccccggtccccccagaagcccccaaaagtagaggctcaggccatgcgcgccctgtcaccaggcctgccaaagagccagatctaaggccgggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaacttttccccttccctccctcgtcttgccctgcgcccggggccaccttcatcaccgtcgctgactccgccatccaagcctaggggagaccgaagtgaaggccctggaccaacccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgccttggcctctaaggccctcgggtccccctggaccccggcctcagcaaccctgctgctcccctcctgccaccccagcctccccccctccccgtcccccttcgctcctgatcctcccccggtccccagtagggccgcctgcccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccagcgggcacccgaggtcccagcacccggtccctccggggggcagagacaggcagggccccccggcagctggccccgaggaggcgcccggagtggggccggtcggctgggctggccgagcccgggtctgggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggtcgccctcagccccccagacagaccccagggtctccaggcagggtccggcatcttcaggggcagcaggctcaccaccacaggccccccagacccgggtctcggccagccgagccgaccggccccgcgcctggcgcctcctcggggccagccgccggggttggttctgcccctctctctgtccttcagaggaaccagggacctcgggcaccccagagcccctcgggcccgcctccaggcgccctcctggtctccgctcccctctgagccccgttaaacccaaagaatgtctgaggggagccaccctcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggcccgagcctctccctcgcggagaggggcctctttgggccctcaagtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccagtctcctgtgcactgtctgtaaagtccagcctcccacgcccgtccacggctcccgggcccagcctcgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggtgaggcccagccccctctcgcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttagccccagcccctcctctataagttctaggcaaacctccaatcaccagccaccttccaatgtagtctcttagagagtggctgctacgcattagagaccactttgagccacccacagtaaccacccagcgccaatctgtctacatagaagaagaagaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaaggtcagccaagggacgcgtgttatcccaggctgcccaccctgaggatttccccccaaaatcctcctaccctctctttatgccatgtgtgttgttggcttgtgttagtgctatgtaatgcgttgccgccaggtggcagcctgtttatagatgtgcagtaccccttaatgttaggtctgctttagggctgccaggtggcgcaatctaggattaattcacctgtatccctttccctccacccgcagtaacccagcactggcgtgtgacgtggtgtaaagttttgcctgaacctgtggttgggcaggtacatgccaacaaccttctaagcacccgcgcttgtgttttgctttatctgccgccatcatgcctacattctatcttgcgttacatgggggacaaacatatcatctaattgttgacacggatagtcttggaaacccgtcactctcagtaattccctcgaatccctaccaggaacaactgtcagacactccattaattccactaacaatctttgttggggaaaacacgggggtgcccccaccactcccaccaccccccccaccaccacccccaccacccccaccacccccaccacccccaccacccccaccacctccaccaccttcaccaccacccccgcccccaccacccccaccacctcagcgcagggatgcctggacacaagagccatcacctcttgatagggatccgctaggatatgacgtcgggcatggacctctagcatctgctatgcgaatgctttggatggctaattatattgtaagacaatcacggggtgaccggggccttattttgccacaaggcccacaaacagcccctcaggccaggttggtccagccacatgtcccccctctacgcccgacagcacccaccattttgtcacctctgtcacaaccgaggcttacccctccacaaccactcatgatgccaccaaggcctacccctcctacccctctgccacctgcaacactaacggtgccaccaaggcctacccgtcctaccactctgccacccacaccactactcacggtactacaaaggcctaccgaacttcaacccacaccatcaccaccacgcatgcatctccctgtcttgcatgtgccagaccaatcaatgcaccctcttactcatcaaagcaccccaaatgatccagatagtccagaaccacggtccccgactgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccttggagaccagagccaaacacctccagtcctagcatgcctgaactaagtccagtcctcggtcttcatcagggacaaggggctggggactcaccaactcctggcccatccaatgccgcccccgtttgtagaaattcacacacggcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctcagatgaagattatgtggagggacccagtaaaagacctcgcccctccatccagtaaaaacccttgccctctccagcaaccaatgtatcccaaataaatgttacttcttttgctcttaaccattgacacgcctgtcattctatcaattaaacaagggaaaaaggtttagctattccaccaacacgaccccaaggaaggcttgccaaaattggtgccttgctctcagcactttgccagcaacttatagcatggtaggcagctcaactcggcccgtcttactgcccagcctactctccactcccagtccatgttcgcactcctatgcatttcctgccctcccacttttaccccagtcccaacccaaaaccacacacaacacatagaattgttagtttaaacagtttattgataggtggctgcttttagcctaattgtgtattgctctcgttgccaaaacctgttgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccactgcacctggaatgcagggtgggggcgtggtcccctggaccccagccccgccgatccctcccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtagccgccgggtctgctggtccggtgcacctggaaggcaggggggggggcagtgagggaggggcgtggtcctgggaccccgcgccgactggcagggggtccccatggcacaggcctaggggtccagggggcagccgcggcccagcgcgccccgttcacgggggaggaccgcggccgagccaccaggggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggttattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggcaccccgcgtgccttactgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcttccctcagtgtttgccagcttatttccccagttttcacgtactggggcctgtggacacctgagggagcggccgttggtgggtatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcgccagaggacactgtagttctgcgttatcatgtgttgcttgaggagataattgaacgaaattcagagacatttacagaaacttggaacagatttataacacacaccgaacatgtggatctggattttaactcagtatttttagagatatttcaccgtggagacccaagccttgggcgcgcgttggcctggatggcctggtgcatgcatgcctgcaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcggggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggatatacgcctgtggtgttctaacgggaagtgtgtaagcacacacgtaatttgcaagcggtgcttcacgctcttcgttaaaataacacaaggacaagatactaaagaaataactgaggtgagtgtgggaagatgggaatactatgtgttatgttaacgggtgagagcctatactgcagcccagactcggggggaggaggaaatggtaagagttatactctacttatcttttttgacactacatttaactgttatgtaacaatgtttgcttattttcatgttcaataaacgctatgttaatgatgaagaacctgtgttctttggaagtgggcccaatggggtagtaggttttgggagggtgccgtgctagatatttcaactgccacagaccccattttgtcccacctgttaccacattctaggtcctgcatccagtgggccaggtgtctcaccatggctctttctaggtggataccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagttttaagagttaaaagcaactactgtttattttccaaaatgagctgggtatagttgatgatctgtaggcgcagctcatccccacattccaggtccttgatggcctcgtagatggcatcttcgtcgacattgacagccttctcatataccgtgtctctggggctgacctttatacagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgatcgggccacactgccaaccctttccattcttcccagctctgagcgagattttccacacctggacaccgacttcacgctatgcgccgaggcctttgaggccgtgtagtttctgtggtgcggatgcattaggcggcgcaatgcgggatctgccggtcgctgttggcgtgcattcacggcatctggggtgaccggggccatcgggtttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctacgaagactccgggggcagtcttttgagtttctcgcctatgatccaccccaatctcgcccccctaattgcgccatctgcctacgcgaggctgaacctcctgaatcactgcatctttcttgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcccgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctggcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccccgagacccgggagacggtggtggggggagcatggcgttattcttggcgcgccacaccttatctggcacgggtgctggctgtcacggccgtggccctgctcctgatgtttctgaggtggacctgacgttgcaggcccttggggagcgggggttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagtggtcaccggtggtgggtgtggagccgtggccttttgcaacgcctttttcctagcttattttttggttgtgcggtctgttttccccgcgttttccgatagaatagctgcctggatctgcgaccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagtgcccactgtcttctgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccccgggcctacaagtgtttcagatcccacgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcggccccgaatccgggcagtgctgccgcacaacgcggcctacgagctcgaccgtggctcccgcctcttggatgccatcatcccctgcttgggacccgaccgcacttgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaagaagttacctggtatttctgacatcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccacgacaccgccccacgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacagtactcggctagcctgactaagggtgaggctataacgcaggtcctgttccggggcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttgaaaaggcgcgggatagcgtgcgctaccggatggcgggtaatacatgctatccttacattttggcattttgggcagctgggaggcggcggatgggggtgcttcttttcgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcacccaccgctttaattgtgggggtgggcagggcagctgcatcttggggcctttgtgcttgcgttttttgggggcgcggtgccaatgcaccaactggggtgtgcgccggggcggccaagccggaccccagggcgggtgcctgggggatgggaaagccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtggataactgggcttctgtgaaggcaccaaccctggaatctggatggtatgtttcttctgtgaccccgaggcagtcgatggtgtagagtgtggagacaatgtgtagacgatgggcccttgttcagaagcccagggacttgaggggggctgttgtggtgctggttggggaaggagctccagggaatctttgggccatggccttggggagcttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgccaggggccaccttctctaagagggggctctgtgggctgggagggccagaggcctcagattcagcagtagtgctccccttttccccctggtccgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtccggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctctggctcgaaagactcggagtagccgtccaggtcctgcagaaaattcagcgagatggtctccaccagggaccggaagggctcagagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctggggagctcttctccgcgtgtataggcctgcttcacaaagtcgcgcaggtagtcctgaaatgcgaccgggccctccagcgggcgcaatgagtgccagagctgctgaagggcctcgggggcgaagcaccggcgtgcgaggagcagcatgcaggctcgggcgcgggccgtactttggttgtggaccaggcccaagaactcggggtgcggccagagggcggctcgggtatccatctcctcccaggcgtcctggaagaagatgaagccggtgggtggaccggcgatgcggtggcgggtgaggcggcgcgcgtcttccccgtcgttgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccatcatctcccgttgttccaatagaataacttcccggtctgtggccggggctggataaggggggtgattcctagaggcgatgagactggcgtgcgctaaaagtgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagggcatactgggagccagccgaggccccaagcgccaggcccctggcagcctccaccacgatcttgagctggcgcgggtcggtgtggcccctggcctgggtgaccagatcctgcagcgttccctgcagctgggactcttcctgggcctcctggatgatggcctccagtcgggagaggcgccttttccagtctgcgacggtctccttgccccccgcgacccgcttggggtccaacgtggccagagccaacctcagctcctccatgccatccatggagttctgggccatgccctcgacttccaggagccgtgttagctcatgaatttcaccgtcagccgcagcggctaggttcagccaggcacccgcgcccccagctaaggccagggctccttcggaaagaccccgcacggcctcgcagatgccccggatccacttggcggctgccagggatttccggtagggccatgagccgttcccggccgctgcccgggccagggcggcctcgaggggagcctggacaggggctttgggcggggagggaagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggcttcttaggccagagcgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgctcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggccgcttcctccgctcctcgccctcctcctccttctttggcggtagccgcgggggtggcgggccaagcgtccagtctggccagagggccggtctcgatatccgtgaaccagccgggttccgcggcctccattctctccgccgcaccaccatcgtccacgagcagggatcgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcctgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgatcgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtactttttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcactgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctttcgtcgtccaggaccaaggggacgtccacgtgcgggcccctgtagatggaattatcctcgggttctcctcctccttcccccgcctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgcttatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagacgatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggctcctctaggtcagacaggtagcggacgaggccagaacccccagatgcatcatccccaaaggagggctgctgcccgaagggaggtgatggggatatctccgttccagccctgtcagcggccgggggatggtttttttctggttcgagtgtcgtggctgatggtgggagctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggcgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgctcgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcggaggccggggccgcagaggccggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagctcttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggtgcgctggctttgcccccagtcgccgttactcatcttcggcggtggggcggggaggacgccttgtcgccccccttctggtccggggtcttacgcggctggcggcggcagccgccgagagataaggggggtacgtgtgtgcctccgcctctcctctgtctgggccgccgccgccgcttgcccgccttgaaggagagggggtagtccgcggactgcgtctgcgggggcaggaggtctcaaccttctgggctcgggccgcggtgtcgatatccgatggcctttccctgtcttcctcgtatgctccttctcctcctcctcccggcacgcccctgagatctgcctcccctccctctccctcgtcctggtcggaaaagtctgaggaggagaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcggcgagaaccgaggggcttctgggggtgactgtgatctgttccggatttaggtccatggcgggtgtgtatgttttaataggggtggtctctggcgcggcaggatgatggtcgaggacgtccaccagggccttgcagatgctcttgcctagatacaggatgtcgtccatgctgaggggaggtggggtgtctgctcccccctgcggaagccgcctgggtgcggggatgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgagatccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggaggatgaaacgctcttttccttcaccgctaccaccgcctcctcctcctcttccgtcgccagagggatctgcaccctcccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccaccgctgccgtccactgccttcttccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgctttcttcaccctctcccccgccggccccgcccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggatgccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggtggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggagtatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactatggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgccggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccgcgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtgcccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttcggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcaatgtgactgtcttgtcctgtaggtcccacttctttctgggaatcacaaacgatgccgaggtaggggttatgaccacgctggagggccgtgcaggtatggcgtgggccggagttggatcttcatcctcctcctctgaggatgaaatctctccatctgtggagtgttcttcgctgccctccatagggtccagatcgcagtctgtgttggtgtctgagaccgcttcgagttccagaatgtggctctctgcagaggggagacaaaaggtggagactgccttgagcacctctgtctcaggcaccggatgcccccggctccacggccccggccactggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggggtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggcccccttgatctttagatccaggtccaagaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggatgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccatgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagcgcggatctctcgcgagtcccgccgcagtttctcgtgtgcaaagtgggcaaaagcctcggtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgtttcttagcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggtgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatcgaggatggcctccgcaatgtcagtgtttgaggccacaagggccttgatgacgacgggggcggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgctgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattggtaaaacaagggatatgaaggtgtcattgacccgaggatccaaaccccctcccctgtctcccctcgagcgcctcgctcagcccactatcacccatggccaggctcggcacctcctcgaaggtgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtttgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagagggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggttcggaaatctgttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccccaacgccacccgacgtgcccgctcccgctcccggggacgtgaagcaaagaaagtgcaaatttctgattaataaatttttattgactttatacataggtctcggcgtcatcatatggtggggtggtgtaggtatgggatgtagacaagttacgcctaaaggcgcagtccgccatgaccagcagcagcagaagggtcagcacagccagagaggcccactgcagtactagcatggagaggtttgagaatctgggctgggacgttggcgggactggcacggtggcttgggctgtggtaaccggtgggctcgtaaaagtccagcggggccgcagtttgctagaagtgctgggaggtagataggtggtcgcattgtatctcggtcttggcgtagttgaatcaccgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcattttgggggggcgtgcctttggtgacattaacctcccccggttttgtggatgtggaactgtttccagggcctgacgcttggctggtggtgcctgggcggggtgctggcgaactggtggacacatgatgtgtgctgatagaggctggtgtcacctgtgttatattttcaccacctgttgggtgagcggaggttagtaaaggcatatgtgacgttgaattgtcactggtggaggggctgagtgtctctgggtttgaactgggtctcagtgacatggaagaggttgaacttgaagttatgttatgttggcctgtggtaacagcactggttgcattttttggttggctggtaactactggggtgggacttgttcctcctaaggtgtggttggtggcatttgcctgtggacttgtttctcccacagtagggccggtggcatttggggttggggtagtcactgctgaggtggggcttgtttttcccaaggtggggctggtggcatttggggttggggtagtcactgctgaggtggggcttgtttttcccaaggtggggctggtggcatttggggttggggtagtcactgctgaggtaggacttgtttttcccaaggtggggctggtggcatttggggttggggtagtcactgctggggtggggctggtggcatttggggttggggtagtcactgctggggtggggctggtggcatttggggttggggtagtcactggtgaggtggagctggtcatgtcgggggccttactttctgtgccgttgtcccatggagatggacttggtgtcaccggtgatgcgcctgacgttgtgccggctggtgttgggctggtgacatccgcggtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgtcttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttctgtttttacgctgaaattcgagtcttgagctgacgttggcaaacttaagggtagcgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtgcaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaatgtcctcatagagttatcagatagcagctcagaaaaggaagcagaagatgcccacctggagccggcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaagtgtgtgatgtgtgtttttacccatcacacaacaacaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcgacacttgggtgcacaggtggccgtaggtgtcacgtgaccttttccgccggcacctttaagctgccgcgatgtacccccggggatcgccagtggttgtatgttcagagctccgtgggtaacattgtacagagctgtaatccccgctacagtattttctttgactatatggctatacacaggagcctcacgaaaatctgggaggaagttttaacacctgaccagcgtgtttcatttatggaattcctaggatttttgcagagaacggatttgtcctatatcaagagctttgtcagcgatgccctgggcaccactagtatccaaacaccgtggatcgatgacaatcctagcacggagacggcacaggcttggaatgccggctttctccggggtcgtgcgtatgggatagacttgcttagaactgaaggggaacatgtcgaaggtgctaccggtgaaacgcgagaagaaagtgaggacacggagagcgatggagatgatgaagatcttccttgtatagtgtccagaggtggacctaaggtcaaacgaccccctatatttataagacgtctgcacaggttgctgctgatgagagcgggcaaacgaacagaacagggcaaggaggtactggaaaaggcccgtgggagcacttatggcacacctaggccgcctgttccgaaaccaagaccagaggtcccacaaagcgacgagacagctaccagtcacgggtcggcgcaagtcccagaacccccaaccattcacctagcagctcagggaatggcatacccattacatgaacaacacggcatggccccgtgtccggtagcacaggccccacctacgcccttgccccctgtatctccaggggatcaactcccaggtgtttttagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagattgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccccccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacctgagcagtggatgttcccaggtgccgccctgagccagagtgttaggccaggggtagcgcagtcacaatattttgacctccccttaactcaacccattaaccatggggcacccgcagcccatttcctccatcagccaccaatggaggggccgtgggtacccgagcagtggatgttccaaggtgccccccctagccaaggcactgacgtggtccaacatcagctggatgctttggggtatacactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtgggatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattgattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgcgggcaggccatgaatattgaggctcctagactgccagatgatcctataattgttgaggatgacgacgaaagtgaggaaattgaagctgaaagcgacgaggaggaagacaagagtggaatggaatctcttaaaaatataccgcaaacactgccgtacaatccaacagtatacggcaggcccgcggtgtttgaccgaaagtcagatgcaaaatcaaccaaaaaatgcagggccatagtaactgactttagtgtaatcaaggccattgaagaggaacacagaaagaagaaggcagccagaacagagcagccaagagccacgcctgaatcccaggcccccacagtggtcctccagcgaccacccacgcagcaagagcctggccccgtcggcccactgagtgtccaggctcggctggagccatggcaacctttgcctgggccccaagtgacagcagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaccacgtctcaacttagcagttcggcaccaagctgcgcacaaactccatggccggtggttcagccaagtcagactccagatgacccaacgaaacagtcccggccaccggaaacagctgccccacgccagtggccaatgcccctgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgcagacaccaccgagagcgcccactcccatgtcaccacctgaggtgccacccgttccccggcagaggcctcggggggcgcccactcccacgccacctcctcaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcaggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacgggggggcctcgcactctcccgtcgttatcttggagaatgtcggccaggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctagacagtcacccgacaatgagcggggagataatgtacagactaccggcgagcatgatcaggaccctgggccggggcctccatccagtggggcttctgagagattggtaccagaagagtcatactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatataccgcaaggaatatcagggatgctgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacatcttgtgcttcgtgatggcagccaggcagcgtcttcaggacattcgacgtggacccttggttgcggagggcggtgtgggttggcgacattggcttctaacatctcccagccaatcctggcccatgggatatcgtacagcaacactacgcacattaactcccgtgcctaacagggttggggctgacagcatcatgttaactgccacatttggatgccaaaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaacacgtaatccagaacgcatttcgaaaggcacaaatacagggtttatcaatgttagcaacgggaggtgaacccagaggtgatgctactagtgaaacgagcagtgatgaggacaccggtagacagggttcggacgtggagctagagtcctcggacgatgagctgccatatatcgatcccaatatggagccggttcagcagaggcccgtcatgtttgtgagccgtgtgcctgcaaagaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccacccgaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgtggggcctcctgccgcggggcctcctgccgcggggcctcctgccgcggggcctcctgccgcggggcctcctgccgcggggcctcctgccgcggggcctcgcatactggcgcctctttccgctgggcctcctgccgcggggcctcacatagtgacgcctccttccgcccggcctcgtataatggcgcctcccgtcgtacgtatgtttatgagggagcgacagctcccccagtccaccggccgtaaacctcagtgcttctgggaaatgcgggctggtcgtgaaattacacaaatgcaacaagaaccaagttcacacctgcagtccgccactcagcctacaacgcctcgcccatcatgggccccatcagtctgcgccctctcggtgatggatgctggtaaggcccagcccatagaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccgcccccccaggctccataccagggataccaggagccgccggcccacgggctccaatcatcttcatatccaggatatgcgggtccctggaccccaaggtctcaacatccatgttataggcacccctgggcaccatggtctcaagatcctgtgcatgggcacacccagggtccatgggatcccagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccccctccccctatgccgttacaagatagcatggccgtggggtgtgactcatcaggtacagcatgcccaagcatgccctttgccagtgattacagtcaaggtgcatttaccccactggacattaatgccaccacgccaaaaaggcctcgagtagaagaaagttctcacggacctgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggccgtcttgttaaagttaaccggcggtggaggatccaccggccagacctctacatttggtttgggtacccaggtgatggccgcggctgccacccgccctcctcctcttaccctgggtggcaaaaagtatgccaggagtagaacaataacaagtgcgatggcggtaaacaatggcaccctcacctgcttaaatgaaaccatggcaaccacttcaaagagagccgacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagcagccacctgcggacaaaaatcaggcgtttagatggggcatttatgtttgggacgctagccgcctgggcattcgtgttagtatatactgacctcacggtagtgctgcagcagttgcttaaacttggcccggcattttctggaagccacccgattcttgtatcgctttatttctagttcagaatcgcattcctccagctgcgagcaagggaatgcgttactacaagtggtgcctagtcagttgaaacaagccccaccatccgctgccgcccctccatgagccccaccgtccgctgccgcccctccttgagcccctccttaccgattctggctgttgtggtttccgtgtgcgtcgtgccggggcagccactggtgcaggctgtggaacaccaatgtctgctagctgttgtccttggttagccccggggcaagcaaacaccactgctgctgctgtttgaacagtagaattgtctccaggttgaggtgcttctcccccggcttggttagtctgttgattctgggttatgtcggagactgggaacagctgaggtgctgcataagcttgataagcattctcaggagcaggctgaggggcagaaaaccacgacccagtcggagcggttgaaacatgataggcagttagctggccttgtggcagaggctctggcagcaccggccacagcacacaaggcaaaggagcttgcgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctatgaggtacattagcaatgcctgtggctcatgcatagtttctaaaagaggaggaggcagttttcagaagtgtctaaaataagctggtgtcaaaaatagacagcccagttgaaatatgcatggcatgcagcagacattcatcatttagaaatgtatccaagatttcattaagttcgggggtcaggggggagtccagattcaaatcctctgtcatggactctagtgttgtggtcagttcgtccaaatggccacgagggggcgggtggctcaggtccatctgtccacatatggctgcttcctccttctggggaataacagtgtcagccatctcccttagggccttcacggcctgactggtttcttcatcagggtcctccaacagatgacttgcctcgggggttactgcgggggccgggtcaagtggctggggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttccgccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaaggccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacacccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcacgaaatccctgacctcgatgactccgatgctgttttcgcacgcaccttattggcagccttatttcacctcaatatgttctttattctcaaagattacataacacaagactccatgagcttgaagcaggccctcagtggtcattggatgtctgccacgggcaaccccctgcctgcagcaccggaaaccctgcgagactacttggaagctttccgaaattcggataatcacttttatctcccgacgacagggcctttaaacaccttccaatttcccgaagagcttctggggcgcgttgttgttattgattcctctttgtgtgccgccagtcacgttcaggacgttatcacccatggtgttggggcgggtgttcctcgtcctcggttttcggccctgcctccggccccatcccgcgagccccagcagacatgctctcagttaacgagcagagggaatgaaagctcacggcgaaacttgggccagcccggggggacctcccctgctgttcccccagtttgccccatcgtttccctgacggcctcaggggccaagcaaaaccgcgggggcatgggatccttgcacttagccaagcctgaggaaacctcccccgccgtctccccagtatgccccatcgcttccccagcggcctccaggtccaagcagcactgcggggtcactggatcctcacaggccgcacccagcttttcttccgttgccccagtagcatctctgtctggtgaccttgaagaggaagaggaggggtcccgagaatccccatccctaccgtccagcaaaaagggggacgaggaatttgaggcctggcttgaggctcaggacgcaaatcttgaggatgttcagcgggagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggagagaagggagacacatctggaccagaaggctccggcggcagtggacctcaaagaagagggggtgataaccatggacgaggacggggaagaggacgaggacgaggaggcggaagaccaggagccccgggcggctcaggatcagggccaagacatagagatggtgtccggagaccccaaaaacgtccaagttgcattggctgcaaagggacccacggtggaacaggagcaggagcaggagcgggaggggcaggagcaggaggggcaggagcaggaggaggggcaggagcaggaggaggggcaggaggggcaggaggggcaggaggggcaggagcaggaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggaggggcaggaggggcaggagcaggaggaggggcaggaggggcaggaggggcaggagcaggaggaggggcaggagcaggaggggcaggaggggcaggaggggcaggagcaggaggggcaggagcaggaggaggggcaggaggggcaggaggggcaggagcaggaggggcaggagcaggaggggcaggagcaggaggggcaggagcaggaggggcaggaggggcaggagcaggaggggcaggaggggcaggagcaggaggggcaggaggggcaggagcaggaggaggggcaggaggggcaggagcaggaggaggggcaggaggggcaggagcaggaggggcaggaggggcaggagcaggaggggcaggaggggcaggagcaggaggggcaggaggggcaggagcaggaggaggggcaggagcaggaggggcaggagcaggaggtggaggccggggtcgaggaggcagtggaggccggggtcgaggaggtagtggaggccggggtcgaggaggtagtggaggccgccggggtagaggacgtgaaagagccagggggggaagtcgtgaaagagccagggggagaggtcgtggacgtggagaaaagaggcccaggagtcccagtagtcagtcatcatcatccgggtctccaccgcgcaggccccctccaggtagaaggccatttttccaccctgtaggggaagccgattattttgaataccaccaagaaggtggcccagatggtgagcctgacgtgcccccgggagcgatagagcagggccccgcagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagctctcctggctaggagtcacgtagaaaggactaccgacgaaggaacttgggtcgccggtgtgttcgtatatggaggtagtaagacctccctttacaacctaaggcgaggaactgcccttgctattccacaatgtcgtcttacaccattgagtcgtctcccctttggaatggcccctggacccggcccacaacctggcccgctaagggagtccattgtctgttatttcatggtctttttacaaactcatatatttgctgaggttttgaaggatgcgattaaggaccttgttatgacaaagcccgctcctacctgcaatatcagggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccatctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagcctggcctccttaaattcacctaagaatgggagcaaccagctggtcatcagccgctgcgcaaacggactcaacgtggtctccttctttatctccatcctgaagcgaagcagctccgccctcacgggccatctccgtgagttgttaaccaccctggagactctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccgttattgcctgtgtccgacgcctgcggactcaggccaccgtctacccagaggaggacatgtgcatggcctgggcccgcttttgcgacccctctgatattaaggtggttattttgggccaggacccctatcacgggggtcaagcaaacggcctggcattcagcgtcgcatacggctttccagttccccccagcctgaggaacatctacgcggagctgcaccggagcctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcatcactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgacgaagacccatctgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttcagcaatccaccaaagacaagggtccccatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggccttggctatggtcatggccagctttgagctaatgccatagtcacggatgctgcagaggttcagggacttgtcctctatcgtctcatacagtttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgcctccgtagatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacaccgagctgtgcttgacgtaggtgacattgtaggtgaccttgacccgttcttcgtcctgctcggtgcccaccgggaccatgtcttggtcggcgaactgcgagtagttaccgaggcgtgcataattcttttggagccaggtgtgggccgtgaggcccggaagcccgaccagggtcttgtactgggccaggggatcgaggaagacctcgcactccaccgggcaggtaaacatggtcaccccgcccccatctcccccggttccccgcgcggcacgcccctgcccggcagtcttgagcgtggcatggagggtggtgaggaaggtcttgacctcggcgtgggagaggaagagccgggtccagcccacgtactgcgcggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtacgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgtgaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgttggacgcggcgcctagccagggtccctatcctcctgactatacgcctcacggaggcgtctgaggtcatgttcaacatgaacgtggacgagagcgcctctggcgccctcggctcctcggccattcctgttcaccccacgccggcctcggtccgactttttgagatcctgcagggaaagtacgcctacgtccagggacagaccatctacgccaacctccgcaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgagccggtttcgtgagtccaccttcgagtcgtggtccacgaccatgaagctgaccgtgcgtgacctgctgaccaccaacatctaccgagtgctacacagccgctccgtgctctcctatgagcgttatgtggactggatctgcgccaccggcatggtgcccgccgttaagaagcccataacccaagagctccactccaagataaagagcctgagggacaggtgcgtctgtcgggaattggggcacgagaggaccatcaggagtatcgggacggaattatatgaggcaacgaaggaaataatagagtcgctcaactccacgttcatcccccagtttacggaggtgaccatcgagtaccttccgaggagcgacgagtatgtggcctactactgtggccgccgcatcaggctgcatgtgctcttccccccggccatctttgccggaacggtgaccttcgacagcccggtgcagcgcctctaccagaacattttcatgtgctaccgcacgctggagcatgccaagatctgccagctcctgaacacggcccctctcaaggccatcgtgggccacggggggcgagacatgtacaaggacatcctggcccatctggagcagaactcacagcgcaaggaccccaagaaggagctgctgaacctgctggtcaagctctcggagaacaagaccatcagcggggtcacggacgtggtggaggagttcataacggatgcctccaacaacctggtggaccgcaaccgtctatttggccagcccggggagacagctgcacagggcctaaagaaaaaggtctccaacacggtggtcaagtgtctgactgatcagataaacgagcaatttgaccagattaatggcctagagaaggagagggagctctatctaaagaagatccgctccatggagtctcagctgcaggcctccctgggtcccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcaatacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcgagcgcgaccgggggagatcatggcatccggcaagcaccatcagcccggggggacacggagcctgaccatgcaaaaagtaagcctgcgcgtgaccccccgcctggtgctggaagttaaccgccataacgccatctgcgtggccaccaacgtccctgagttctacaatgccaggggggaccttaacatccgagacctccgggcccacgtcaaggcccggatgatctcgtcccagttttgcggctacgtcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaatggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttctgacctcggggaagatggggtgcctggccaggtcacccaaggattactgcgcggatctaaacaaggaggaagatgccaactcgggcttcacatttaacctgttttatcaagattctttattgaccaagcatttccagtgccagaccgtcctccagaccttgagacgcaagtgcctcgggagtgacacggtctcaaaaataattccctagaataaactgagaacagtcatcagtaaatctgtctctcgcgtgatttccataggaatggtgtagccggggtggagggccgatatcacatcaagcagaaaggccataatctctcgaaagtaggcggtggggctgagaccatgctcagtggccgtctggcagggggccgggcgcgctccgtccttgtccaggagacacacgtggcttccagagaggcgcagcccagccctccgcagccgctgaagccaggctcgcggaagagcccaaaacctgtttcggcgccgcccgggggccagtctccgggtcaggtcgcggaccagggtcaacaggtggtcgtgggatggcggggccttgtctgcctcgggtctcgccgctagttggtccagggtccaggagaaggcttcgtgccaaaccaaaaagggccccgagtgctccctacatccacccacgtaaagatccccctgaaagatggccatcagtaggcacccgggcccgcgtcgagccttcacccgaatgtgtctgcgggccacggtggcctctccacccatcacatcccggtcgagccggctggcatcctccgagtctttcacgccttgcaggaaagcctaggagatacagcaacagaaagctattagccggtggttcccccaccatcattcttcctgttaacgggaagaataagagttgggcaaaccccgggggccgcgctctcccacccagccccgcttctcacctgtgctagtggctcctctgaaggatgggcggaggttggtgccacaaagcccaggatgaactcgtctgcataagcccaggtcagtcctaggtcagcggccgcgtgtaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacgggggcgcccctggcagagaggtggcagcgggccaattcgtagagccaccaagtggcatcagcctcaaggatggctgtggcctccgcgcgcccgaccaccgtcgtctcgtcctccccccctccctcgccgccttcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcaagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccatctcggacccgaagccatcaacaggtgggggttgttggtcccgcccatcatcccccgagcagctttggcagaccacctgtgctggaaagagaggctggaagatgaggccctgctcatcctccaccctggcggcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtaacattataaaaggtaaccgagctgacgcgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacacgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcctgcggcacaactttggcttctactgcggcatgttcatcgcctccatcatcctgatcctgcccttggtcaggtacgaggccgtctttgtctccgccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacgacggacagcgaggaggagatcttcccctaatgcaataaaaacttaaaacactgaggttactttcccgtcattctttcgggggaacgaggggaggcgggaattgggttaagataggggcgaagggtgggggtgggtgcaagaattggggctgggaatggagaggggagtgggctaggtgccgacaccggggtgccaagataatggattgagtaagcatggggctctgatcgggtccgccgggttctcaggggtgtagtgggtgggcattgcatatttttgccgcggtgctgttgggccttggactcggggtgatcatccgtaccatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcggccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaattctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggccacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtccttgctgtcattctcttggactaacgaggagacaaagtcacagaagccagtttcaccagagaactcttgtatttgtttacagaggcaatagagatagacaaagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctacccatgccccacatggtgtctgtgaaatccaccaggatgttgctggggctaatgtccgaatggaagaggccgcagtgccgattcagaaagtaaacggcatctttgaggccctgaaagccccgcaccaggggctcaatactaccatcatgccagtggccataatcctggagactgcatctgaactggggcataaacagggcgtggcaggacgtgcaggccgacaggtagtccaccagggccttgtcctgcccatcctcggccgtggccttcccaatctgaatcatgtcacacaccatgagctcgtgatacagctccgtcacagagtcatagagtttgaccgtggcattatctgcatgtgcatacacggccccgtagctcccccgccccagcagatactcgcaggtaatggggaggtgatcacagcgcgtcatgttctccggcagctttacatagagggtctccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgtggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagcccagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggccccttttgccccgtgccgcagcgtaaacgcagtgacgctcttcgcagtgggacctggggccgtagaagagggcccacatccaagggagtgggtcttcaggcaccagggaggtccaggtttgggagtgggccaatatttgcaaggcctgacctataacctcatctttgttccaggccagcgcaattcgcataaggtccccatcaaacacctcaaaacacagacccatgcccatttcaggctgagagggctccatccggctcgaccaaccttgtccaccaaactgccattcttctggtaaacgggggttgaggggcaagagctccaaagccaggctcgagaagtcatagtcatcctcggccacacggccggagctccgggcctcgtgccagggcctgttgtcctgggggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacaggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccctgcccttcacaccccagtccaggtccagatgtgcctactaccagagctacgcgacacgttacagcgcctgctgccaccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcggattggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacacgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccacccgggggcctggagtcgatcaccttaccccaggccgaggccccttcctcatacagcgggtggctatctatccataggcaggcatccggcgtctttggtgcattggagatagtagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagagtgcccccgacccgacccccacagtgccgccagtccctgctcggcctccgccgccttccccaccggcgctgccccggatgttgctggggttctcgagggctgggtggtgcttggacacagaggtctcagcagccgccttggtctcggccccggccctaagtctgagccccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgataagatgcccgtcggtcagagcccttttggccccctcaaagagagacaggtaataaatctgtagctccccaaccagccctccttcatcgtaaaatcgaagggcggccacgtggaaggggttgtagagctctggaaggccctcatcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagcgccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgcctcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatccgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacggtacctacacctacaccggcaagcagcgcaacctctctgacgacgtgctggttgcgctagtcatggctcattttctcgcaacaacacagaagcacacgttcaagaaagttcattaaactttattgactacaccagtcccttgtaaagcgacgggtctcgcgtgacggcattcgtgagcagggcttcgtccaggggcttgttcttggcggacatcattagcccagccgcaaatatcagaattagcatcagaaaagtgagccccacaaacaccagtgtccagagaggaagaccgtaagataaagatggctgcctctcatctggaacggtgggaagctcagcagttgtttttgtggcattggacgtccctttggaggacagcgtgggggccaaggtggtagcgttggtaatacgggtagtagcactggtggtggaggaggacctggtggtgacattgctagtcacacccgtggaggttcctgttccggcctcggtggcagtgatgttctgtgcagtaaccttagtggtgacattgatggtggatgcgttggaagttgttgggactggtgtgacagttgtcccagtgaatgtcaccgtggttgtgttggtgctcagaatagcagttgtggttataggggcgctagtcgtggtcaaggtcgtagactggtttgtgctaggacccgatgccgacggtgatggtgtagtcacagccgttgtgcctgtcacgttccccgccgaggccgtcgaactgccactagatgtccaaataaggcttgtctcacagatgagtatcatggccataacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcacgccccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcgctcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgggtccgggtggtctgattttgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatttcctggaagagattcaagaggtcgtgatgctcatgccggataaggcctcggaccaggcgcatactggccctgggcagcagggtcaccatgatgcaaaagtagagactcagattgtccagcagggccaagccaaggggccctggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaataccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagtcccctgttgttgcgcagaagctcctccttgttgaaaaatgcccggcaggggctgtagaggcccgggacggccgtctggcgataggaggagttgtacatgatgtcacccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagcgtcccattgcgctgagcgcccaccttggccttgatgtagtcattgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctaacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaaacgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcgtgaaagagacactgggtgacggcccgggtcctctcggagaaggcaaaggccaccagcccgttcaccaaaacagtctgctctgtccgcttgtcggcgggattcggggccagctgctgcgtaacgtcattgtccaccgacacacgcacggcacgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggttgggaggaaaacgtagtaaaagatcttttccagcacatccgcatgcccctcatctacataagggcctaggtgcagacggaaatcgtggtcgtggtctccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagagcgcagacatactgacccacgctctcatcccccacaacatctgacccggccaggcgcatcagggcctgctctagggctataagttccccatagatttttctatacatggaataggcctccttggagatggcgttatttcccaggtggcggcagatgaacttgatcatggaaaagctgttcacaaaggcaagcctccctgaccgttcccagtaggtgttgatgcacagggacaccaaaggcacgttcatgacaaacttttcctcaaacccgtggatcatagcctcgactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacagccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtgtacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccataatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcatggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattccgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacaacccctcagccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacccacacttcccgaggatgctacccttctaatcaaatggttggacacggccctgggcagggaggccaccttttacgcgtgtcgggctatgcgtcggcttctactcggcgttatccgaatgaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataaacacgagctcaatgtttcgccttatcatccgctacttgtctcatcaccaatttgagcgctgcttcgagcagttctgccgcgtggtcccgcgtcgcttcctagggacctgtaagcgaaactctgcaaagatgctggctcatctgaatcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggatactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcccgcgagcttccagttcccctcctccccaactggctccctattgcgatgcatagttgctgcgtccctgctgccggaggtgtccgtggggcaccaggagctgtctccgctgcggtccagaagccagggagggcagacggatgtcaggtcgggcccggacccggcccggagactggtggccctcctgcgaagggaagatggggcacctaaagacccccctctgggaccgtttggacacccccgggggcccggcccggccaagagcgaagacgaggagtctgagcgtcgagacgcccctccacccccgctcgattccagcttccaagcttcccggttggtgcccgtggggcctgggtttcgcctgctcgtgttcaacaccaatcgggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccgggacggtctcaacgtgtcctggtttaaggccgcaactgccaccatatctcgagtgcacgggcagacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagctggtggtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccactgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagagcaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaaggcaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctccccgtctgataccatcagtgaggctgaaaccaaggcctttgagaagctggtggagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaactggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacattgatgagcgggataatcatcagaactttgtcgagcctgtccacgcatttgtaggcggggagatgccacgcatccctgtcttctcgctccaaagagagccgcccaagaaacccatccacagcatttgaaacggccgcctggtccagcgttgcctcctggggggccatgctcagcagcttgtctcgtgtgaggtcaaatcgtaggctgaggtagcacggtgagaagagcccgctctctgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtagtcaggtgacccagctcctccatcttgaccgtggccatcagcatggcggccaagcgctccagcccgtaggattgcatgcccttgacagtggccccataacatatgccgatgatgtctttcaggacagtcagctcaaagaagctcttggccaaccagcggaggtccacgcagccattgccagtctcacccacagcatgacccaccttaaagaaggccacagaaacctcaaacatggtagtcagcgtttccgtgtccagttccggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagaccaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctgaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtggtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgttaggtgggtcacaattggaacccgcatgctctccttcctctgagccttggcctggcgggtgtcttgggcatcatccagattcagaacattcatcacactcccacttagccgcttcagctgggcagcatgcttggataacttactaaactcgcgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccggccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgctggtggctgggctcccctgggcagggtaaaggggcacgatgtgtgccggctacccggagagtttccagtattagatgtcacggcagcctgggtccggcacggcaccctctccccagacagtccggtcggagccatcaaggggggccagtgggtgggcacctggtagaggccgtcgtcatcttcctcacctgcccctgagtcactaccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccggggtctgtgtgccctctccacacacgacctggcaaaatttcacagtcttcccccggctagaaaggcggcaggtaagcgagcgcaccttcggtgttactccaagctgctctctcttaagagctgggagcaactggcctcttttttgtctctgcccccgggacccacgtttacagactttagactatttttcgaagtcaccctgggtcggagaatcgcagattgcgttgtggtagctctgcagccttatccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctccgcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtacaggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgccgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcaatgcagcggcgcaagcctgccatggcgtcagctggtatgccgggcgcctatccagtccagacgcttttccgccacggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcgcccctcgcccatgcttgcggcgcgggagatcctggagcgtcagttctcagcctcggatgactacgaccggctgtacttcctgacgctgggctacctggcctccccggtggccccaagctgagccagttcctcgcactggagtgggtcattggcaaaaaggtaaataaactcatcgcacgggggttttgcctccttctcgtctcttgtttcgggtaggggagtaaggccgctgccaggccgccatgctcagggccacggcgtgccagaggccctcgtagtcgtgcgcatccgagaggatggcacggtccagaagcagatagccggccaggcagaggaaggccacaaagagggggcgaaggcgtgcccgaacccgggtttcatgctcgtctgcaccccagtggacaaggcagtagaggacacccaccaccaggcggttagggaggacactgccaaggttgaagagcagatttccgtcagccagggtgacctggctcaggtccggcgccctgcgagtccaagctgcgcccacacacatgcacagacggcccctgtgacatcaggccggtcatgcaaaaacagacaaagagaccgtgagcggttaccggggcgcagggcctctgccgggaagcccacccgggccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgcacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccacgtgtctatctgtgccctgggtcgtcggcgcggcaccacggcagtctacggtacagaccttgcgtgggtcctgaagcactttagtgacctggaaccgtctatcgccgcccagattgagaatgacgccaatgccgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcagaccccgctaccctacgcggccccgctgccccccttttcccaccaggcaatagccaccgcgccttcctacggtcctggggccggagcggtcgccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcggggggctattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccgcccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccaccaccgcggaaagaaactggtgcaggcctctgcgtccggagtggctcagtctaaggagcccaccacccccaaggccaagtctgtgtcagcccacctcaagtccatcttttgcgaggaattgctgaataaacgcgtggcttgaaagtaaactttattgcgtgttagtacctgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagggtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatatgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtgggggaaggagctgacacgattgagtagaaagggccaaaaatacaccagctataaggaattgctcaggccaaagttgttcctcaggtggctttaggcctaatgtaggcaattgcgtgcctagaacattgctaatgtgccctgggtttcctgccttcatgcaaatattctacctcccccggcctggtgcaaaatgtctgcctcagaatactaacagctaatccaagctaacattctatcagtaaacgggcagaaaactgataaggaccgcggagtttggccctccgcggtgtccggtggtcctcacacgtgccctccccccgggccgatggctgaggcccggaatatgcaagtgcatctttctaaccagtaggggcctccacctaggtgctttgttaatctttagtgggaactagtgggagtgctgtgcctcgggtacccctatcctataggtcctaccggagctccttgtcttgataatccctgtaaacacacaccacctaagaacaaggcattgttaacctttggtggaacctagtgttagtgttgtgctgtaaataagtgtccagcgcaccactagtcaccaggtgtcaccggaggctacttgcctcagtgccacttttaccttctcaaatctatacggggggggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctatatagtcacgaccccaccgaaccaggcatgatgtagaataaaattttatgcatcatcttctaatctgtgccgcttggagggaaacatgaccacctgaagtctgttaaccaggtcagtggttttgtttccttgatagagacacaaggactgccagccccattggggagggggggtgggtacgggagagtttgggctcgtttaaacaaagtctcatctgatgctctgtggcacctcaaggtgaatatagctgcccatcgacgtatcgctggaaaccggtgggccagggcctggccgcacgggccatcgatgcggatccagacatgataagatacattgatgagtttggacaaaccacaactagaatgcagtgaaaaaaatgctttatttgtgaaatttgtgatgctattgctttatttgtaaccattataagctgcaataaacaagttgcccgggcccgagtgcgtgggcatgacaatcgtgccctggggaccaacacaatccagaagggcctgaatcactgcgaccggccctcccgcgacccagccgagcgagcttagcgaactgtggacgagaactgtgccaccaagcgtaaggccgttctctcgcatttgccttgctaggctcgcgcgagttgctggctgaggcgttctcgaaatcagctcttgttcggtcggcatctactctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatggtggagggcccccccgcagatctgagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagccaagcttctcgacagcgacacacttgcatcggatgcagcccggttcgcgttaagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatcagttatctagatccggtggatcccgggcccgcggtaccgtcgactgcagaattcgaagcttgagctcgagatctgagtccggacttgtacagctcgtccatgccgagagtgatcccggcggcggtcacgaactccagcaggaccatgtgatcgcgcttctcgttggggtctttgctcagggcggactgggtgctcaggtagtggttgtcgggcagcagcacggggccgtcgccgatgggggtgttctgctggtagtggtcggcgagctgcacgctgccgtcctcgatgttgtggcggatcttgaagttcaccttgatgccgttcttctgcttgtcggccatgatatagacgttgtggctgttgtagttgtactccagcttgtgccccaggatgttgccgtcctccttgaagtcgatgcccttcagctcgatgcggttcaccagggtgtcgccctcgaacttcacctcggcgcgggtcttgtagttgccgtcgtccttgaagaagatggtgcgctcctggacgtagccttcgggcatggcggacttgaagaagtcgtgctgcttcatgtggtcggggtagcggctgaagcactgcacgccgtaggtcagggtggtcacgagggtgggccagggcacgggcagcttgccggtggtgcagatgaacttcagggtcagcttgccgtaggtggcatcgccctcgccctcgccggacacgctgaacttgtggccgtttacgtcgccgtccagctcgaccaggatgggcaccaccccggtgaacagctcctcgcccttgctcaccatggtggcgaccggtagcgctagcggatctgacggttcactaaaccagctctgcttatatagacctcccaccgtacacgcctaccgcccatttgcgtcaatggggcggagttgttacgacattttggaaagtcccgttgattttggtgccaaaacaaactcccattgacgtcaatggggtggagacttggaaatccccgtgagtcaaaccgctatccacgcccattgatgtactgccaaaaccgcatcaccatggtaatagcgatgactaatacgtagatgtactgccaagtaggaaagtcccataaggtcatgtactgggcataatgccaggcgggccatttaccgtcattgacgtcaatagggggcgtacttggcatatgatacacttgatgtactgccaagtgggcagtttaccgtaaatactccacccattgacgtcaatggaaagtccctattggcgttactatgggaacatacgtcattattgacgtcaatgggcgggggtcgttgggcggtcagccaggcgggccatttaccgtaagttatgtaacgcggaactccatatatgggctatgaactaatgaccccgtaattgattactattaaacgtgccggcacggcctgggtaaccaggtattttgtccacataaccgtgcgcaaaatgttgtggataagcaggacacagcagcaatccacagcaggcatacaaccgcacaccgaggttactccgttctacaggttacgacgacatgtcaatacttgcccttgacaggcattgatggaatcgtagtctcacgctgatagtctgatcgacaatacaagtgggaccgtggtcccagaccgataatcagaccgacaacacgagtgggatcgtggtcccagactaataatcagaccgacgatacgagtgggaccgtggtcccagactaataatcagaccgacgatacgagtgggaccgtggttccagactaataatcagaccgacgatacgagtgggaccgtggtcccagactaataatcagaccgacgatacgagtgggaccatggtcccagactaataatcagaccgacgatacgagtgggaccgtggtcccagtctgattatcagaccgacgatacgagtgggaccgtggtcccagactaataatcagaccgacgatacgagtgggaccgtggtcccagactaataatcagaccgacgatacgagtgggaccgtggtcccagtctgattatcagaccgacgatacaagtggaacagtgggcccagagagaatattcaggccagttatgctttctggcctgtaacaaaggacattaagtaaagacagataaacgtagactaaaacgtggtcgcatcagggtgctggcttttcaagttccttaagaatggcctcaattttctctatacactcagttggaacacgagacctgtccaggttaagcaccattttatcgcccttatacaatactgtcgctccaggagcaaactgatgtcgtgagcttaaactagttcttgatgcagatgacgttttaagcacagaagttaaaagagtgataacttcttcagcttcaaatatcaccccagcttttttctgctcatgaaggttagatgcctgctgcttaagtaattcctctttatctgtaaaggctttttgaagtgcatcacctgaccgggcagatagttcaccggggtgagaaaaaagagcaacaactgatttaggcaatttggcggtgttgatacagcgggtaataatcttacgtgaaatattttccgcatcagccagcgcagaaatatttccagcaaattcattctgcaatcggcttgcataacgctgaccacgttcataagcacttgttgggcgataatcgttacccaatctggataatgcagccatctgctcatcatccagctcgccaaccagaacacgataatcactttcggtaagtgcagcagctttacgacggcgactcccatcggcaatttctatgacaccagatactcttcgaccgaacgccggtgtctgttgaccagtcagtagaaaagaagggatgagatcatccagtgcgtcctcagtaagcagctcctggtcacgttcattacctgaccatacccgagaggtcttctcaacactatcaccccggagcacttcaagagtaaacttcacatcccgaccacatacaggcaaagtaatggcattaccgcgagccattactcctacgcgcgcaattaacgaatccaccatcggggcagctggtgtcgataacgaagtatcttcaaccggttgagtattgagcgtatgttttggaataacaggcgcacgcttcattatctaatctcccagcgtggtttaatcagacgatcgaaaatttcattgcagacaggttcccaaatagaaagagcatttctccaggcaccagttgaagagcgttgatcaatggcctgttcaaaaacagttctcatccggatctgacctttaccaacttcatccgtttcacgtacaacattttttagaaccatgcttccccaggcatcccgaatttgctcctccatccacggggactgagagccattactattgctgtatttggtaagcaaaatacgtacatcaggctcgaaccctttaagatcaacgttcttgagcagatcacgaagcatatcgaaaaactgcagtgcggaggtgtagtcaaacaactcagcaggcgtgggaacaatcagcacatcagcagcacatacgacattaatcgtgccgatacccaggttaggcgcgctgtcaataactatgacatcatagtcatgagcaacagtttcaatggccagtcggagcatcaggtgtggatcggtgggcagtttaccttcatcaaatttgcccattaactcagtttcaatacggtgcagagccagacaggaaggaataatgtcaagccccggccagcaagtgggctttattgcataagtgacatcgtccttttccccaagatagaaaggcaggagagtgtcttctgcatgaatatgaagatctggtacccatccgtgatacattgaggctgttccctgggggtcgttaccttccacgagcaaaacacgtagccccttcagagccagatcctgagcaagatgaacagaaactgaggttttgtaaacgccacctttatgggcagcaaccccgatcaccggtggaaatacgtcttcagcacgtcgcaatcgcgtaccaaacacatcacgcatatgattaatttgttcaattgtataaccaacacgttgctcaacccgtcctcgaatttccatatccgggtgcggtagtcgccctgctttctcggcatctctgatagcctgagaagaaaccccaactaaatccgctgcttcacctattctccagcgccgggttattttcctcgcttccgggctgtcatcattaaactgtgcaatggcgatagccttcgtcatttcatgaccagcgtttatgcactggttaagtgtttccatgagtttcattctgaacatcctttaatcattgctttgcgtttttttattaaatcttgcaatttactgcaaagcaacaacaaaatcgcaaagtcatcaaaaaaccgcaaagttgtttaaaataagagcaacactacaaaaggagataagaagagcacatacctcagtcacttattatcactagcgctcgccgcagccgtgtaaccgagcatagcgagcgaactggcgaggaagcaaagaagaactgttctgtcagatagctcttacgctcagcgcaagaagaaatatccaccgtgggaaaaactccaggtagaggtacacacgcggatagccaattcagagtaataaactgtgataatcaaccctcatcaatgatgacgaactaacccccgatatcaggtcacatgacgaagggaaagagaaggaaatcaactgtgacaaactgccctcaaatttggcttccttaaaaattacagttcaaaaagtatgagaaaatccatgcaggctgaaggaaacagcaaaactgtgacaaattaccctcagtaggtcagaacaaatgtgacgaaccaccctcaaatctgtgacagataaccctcagactatcctgtcgtcatggaagtgatatcgcggaaggaaaatacgatatgagtcgtctggcggcctttctttttctcaatgtatgagaggcgcattggagttctgctgttgatctcattaacacagacctgcaggaagcggcggcggaagtcaggcatacgctggtaactttgaggcagctggtaacgctctatgatccagtcgattttcagagagacgatgcctgagccatccggcttacgatactgacacagggattcgtataaacgcatggcatacggattggtgatttcttttgtttcactaagccgaaactgcgtaaaccggttctgtaacccgataaagaagggaatgagatatgggttgatatgtacactgtaaagccctctggatggactgtgcgcacgtttgataaaccaaggaaaagattcatagcctttttcatcgccggcatcctcttcagggcgataaaaaaccacttccttccccgcgaaactcttcaatgcctgccgtatatccttactggcttccgcagaggtcaatccgaatatttcagcatatttagcaacatggatctcgcagataccgtcatgttcctgtagggtgccatcagattttctgatctggtcaacgaacagatacagcatacgtttttgatcccgggagagactatatgccgcctcagtgaggtcgtttgactggacgattcgcgggctatttttacgtttcttgtgattgataaccgctgtttccgccatgacagatccatgtgaagtgtgacaagtttttagattgtcacactaaataaaaaagagtcaataagcagggataactttgtgaaaaaacagcttcttctgagggcaatttgtcacagggttaagggcaatttgtcacagacaggactgtcatttgagggtgatttgtcacactgaaagggcaatttgtcacaacaccttctctagaaccagcatggataaaggcctacaaggcgctctaaaaaagaagatctaaaaactataaaaaaaataattataaaaatatccccgtggataagtggataaccccaagggaagttttttcaggcatcgtgtgtaagcagaatatataagtgctgttccctggtgcttcctcgctcactcgagggcttcgccgtcgctcgactgcggcgagcctactggctgtaaaaggacagaccacatcatggttctgtgttcattaggttgttctgtccattgctgacataatccgctccacttcaacgtaacaccgcacgaagatttctattgttcctgaaggcatattcaaatcgttttcgttaccgcttgcaggcatcatgacagaacactacttcctataaacgctacacaggctcctgagattaataatgcggatctctacgataatgggagattttcccgactgtttcgttcgcttctcagtggataacagccagcttctctgtttaacagacaaaaacagcatatccactcagttccacatttccatataaaggccaaggcatttattctcaggataattgtttcagcatcgcaaccgcatcagactccggcatcgcaaactgcacccggtgccgggcagccacatccagcgcaaaaaccttcgtgtagacttccgttgaactgatggacttatgtcccatcaggctttgcagaactttcagcggtataccggcatacagcatgtgcatcgcataggaatggcggaacgtatgtggtgtgaccggaacagagaacgtcacaccgtcagcagcagcggcggcaaccgcctccccaatccaggtcctgaccgttctgtccgtcacttcccagatccgcgctttctctgtccttcctgtgcgacggttacgccgctccatgagcttatcgcgaataaatacctgtgacggaagatcacttcgcagaataaataaatcctggtgtccctgttgataccgggaagccctgggccaacttttggcgaaaatgagacgttgatcggcacgtaagaggttccaactttcaccataatgaaataagatcactaccgggcgtattttttgagttatcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaatttttttaaggcagttattggtgcccttaaacgcctggttgctacgcctgaataagtgataataagcggatgaatggcagaaattcgatgataagctgtcaaacatgagaatggtcgagttaaacatgcatccttaaggccgagacgggcagccggagcttgtggtactgtccctccggcaggtggagtgggacacagttagagaacattagtcctctggtccctatctccacccgccaggcctgtgtgtcagtttgcagggccatcctcgcactcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttgggggggtctttgccctcaaggcgaggctccttctcctaggaatgccgagccccctgcactagcttcgctccactggggatctttgccagccttcatactagattcagcgatcccccggttgggaatcttcgccagccccccgtcctgctatcccgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcatcggcaaagcgcagggtctcgctctctgaaaacccccggcactcgataaacagcgagtccgtgtccccgtagatgactcgaagctggccctcggggttgaggggcgcccaggcgtccggggagggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccagacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatccgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccacatggcaccacatacccctgtttatccgatggaatgacggcgcatttctcgtgcgtgtacaccgtctcgagtatgtcgtagacatggaagtccagagggcttccgtgggtgtctgcctccggccttgccgtgccctcttgggcacgctggcgccaccacatgccctttccatcctcgtcaccccccaccaccgtcagggagtcttggtagaagcacagggggggctgaggcccccgcacatccaccacccctgcggcgcctggtgtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccgccaccaggaccagaatgagcatgccgccgaaggggtttttgaagaaggagatgaaaccagagaccaggctgctaaacaaaccccccaccgtgctgactaggttggtgatggactgacccacgctacccagactgtccataagttcccccaggccgtccacgaattgatttcttccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtgaggaagatctcgttgtcggtgcccagctgtccctcgtaggtcttggtgtcgttgataaagctgaaggacaccagggggcgcgagtagcacatggtctcggagccagggaccctcatgctcttgcgcagggtgacggtggcctggttaacgggcacgcactgggagactgagatgacatcccccaggcgcttggccgccaccgccttaccgtagatgctggacatgacggtggttggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgtggggggcaccggtgtggtggcgttccccgcatcccgcctccgacgcctcagaacggcggcgggggtgctcccgcgggccgcggatggggctgggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttctcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccttatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatcttgaccgcgttgtagcactggtagatggtatccatctggtcagtttcgtagctgtcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggtgcgggctgctctggggtctgcgcaccgagacggcacgccagggcggctagcagcacgaccacgcttagcaccctacgccgagtcatctctcatttggaggtgcaggtagagaagggcatatagatccttaaatacccaccccctgcccttatacagaagaattagggggcggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaatgccttctggtggggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtacagctcgttcctcttttgcaggatggcccggtactgggggtgcgccgtgaaggcggcggcgcagtccgccttcagcgcctccaccgcgtcgcccgaggagctgtagaccccgccgcagaagagccgctccgtggccccgggagccacggcgtcaaacaggtgagtcagccttgcccccgccagcgcctcctcgcaggccccccgcaccagggccaggcgacgctcccgggcaaacagggcagagaggcgggaatggccgccaccctccccctgccccgttgcaccgatagcatggccgccagagttccaatagaggagctccgagagctccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagccccgcctggcggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtacggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactccgggggtccagccgggtgcacacgctcagctcaaccgccagggcgtacacctggctgtacgccgccgccagcagccccgacatcgccgccccaggggtctctagacctcgagtccggggagaacggtggccagacggcgcttgcgtctgcccccggagccctgccctcctccacccagcagcagcccggccgaggcctgcgacgcggtgctgaccggctcggccacgctgataaagttgtcctgggctgccccgggcccaccccacactccctccagaaagtcccgagcggcctccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcattctcccccgtgaagaccaccctgttcttgatcttgatgttcctggggcacagcatcagcaccttggacatgcgcacaggcagccgccggccgtacacccggccctgcagggccgcgtccaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacagctgggtgaagatggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccttcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatgggactggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccacagcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtagaggacggaattggtggcaaagatctgcgtggacacgtggggggccaggctggcattatatcggtgtaacgcagccacacgggcctctggaccctcacagtcggcaaacaggggccacgagtcgtagttgaggctggccggggtctcgtgcgaggcctccagcatggcgggtgcgtagctcaccgccagctcgcatgccgcgctgtccacaatcattaaggctcccgagtccgggtgactgatggttgaggctgggaactccttgaggggggccaccttggccaccttggcctggtcctgcaggctctgcttctccagcagctccaccagcttgcccacccgtcggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttccctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctccgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcctcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgtgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattgggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtcttgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatgggtacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatacgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggaagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcctggtagttgtgttgtgcagaggtctgatgtgtgtaggaggggtgggttcaacgcaggggcgttggtggcggagtctggcaacgcccgggtccttgctacctgtgtggtgtgttaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagaacccaaaagcagcgtaggaaggtgtggatcaccgccgccatggccggaatcatgactatgaccgccgcctccgtctgtcatcaaaggcgggccctggtcacctcctttgttttcaacctcttccgtcaattgtggagggcctccatcatttccagcagagtcgctagggctatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggctccactcacgagcaggtggtgtctgccctcgttggagttagagtcagattcatggccagaatcatcggtagcttgttgagggtgcgggagggagtcatcgtggtggtgttcatcactgtgtcgttgtccatggtaatacatccagattaaaatcgccagaaacaggaggagccaaaggagatcaaccaatagagtccaccagttttgttgtagatagagagcaataatgagcaggatgaggtctaggaagaaggctaggaagaaggccaaaagctgccagatggtggcaccaagtcgccagagcatctccaataagtagatccagatacctaagactgcgttgaaaaaagagtgttagggttggaaaagtgggggtgtggtaaataattcctagggaatgttagatcttaccaagtaagcacccgaagatgaacagcacaattccaaggaacaatgcctgtccgtgcaaattccagagagcgatgagcaggagggtgactggggaaagaggagaaagtgcgttagagaaggaagagtaagggaaagggggtgtggggcaaagggtgtaatacttactcatcagtaggagtatacaaagggctccaagtggacagagaaggtctcttctgaagataaagatgatcaaaattataattataagcatgagagcaaaggaatagaggacaaggagggctcctccagtccagtcactcataacgatgtacagccaaaacagtagcgccaagaggaggagaaggagagcaaggcctagggaagaggagagggggggtcctcgagggggccgtcgcgggcccggtgggcccctctcaaggtcgtgttccatcctcagggcagtgtgtcaggagcaaggcagttgaggaaagaagggggcagagcagtgtgagaggcttatgtagggcggctacgtcagagtaacgcgtgtttcttgggatgtaggcccggggggatttgcggggtctgccggaggcagtacgggtacagatttcccgaaagcggcggtgtgtgtgtgcatgtaagcgtagaaaggggaagtagaaagcgtgtgtttgtgttagaaaagcgggtccccggggggcaagctgtgggaatgcggtggccaagtgcaacaggaaatggaaaggcagtgcggcaatcagaagggggagtgcgtagtgttgtgggaagcggcagtgtaatctgcacaaagaggcgcggggcgcgcaacgttgggaggtcgttggcggcaggcgggaggccgtgctttaggggggttcaggtgaggcaaggctgtggggtaaccgtaggggaggcgggtgaggcggctaagagggctaagggtcggcgggtgacgaagcagcagacggcggatatgggaatttcagaatgaggtggcggattcaggcgaaaagggtgtgggctgtgcgagtgtcatgaggcaggcgcggaaagtcgctgcggcttgctggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccgtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcgggggggtggggcatggggggccgcgcattcctggaaaaagtggagggggcgtggccttcccccgcggccccccagcccccccgcacagagcggcgctacggcgggcgggcggcggggggtcggggtccgcgggctccgggggctgcgggcggtggatggcggcggacgttccggggatcgggggggtcggggggcgccgcgcgggcgcagccatgcgtgaccgtgatgagggggcagggtcgcagggggtgtgtctggtgggggcgggagcggggggcggcgcgggagcctgcacgccgttggagggtagaatgacagggggcggggacagagaggcggtcgcgcccccggccgcgccagccaagcccccaaggggggcggggagcgggcaatggagcgtgacgaagggccccagggctgaccccggcaaacgtgacccggggctccggggtgacccagccaagcgtgaccaaggggcccgtgggtgacacaggcaaccctgacaaaggccccccaggaaagacccccggggggcatcggggggggtgttggcgggggcatgggggggtcggatttcgcccttattgccctgttt

SEQ ID NO: 11 - DNA, 186282 bp, Artificial
  BBRF1 KO Genome
agaattcgtcttgctctattcaccctaacttttcttcttgcccgttctctttcttagtatgaatccagtatgcctgcctgtaattgttgcgccctacctgttttggctggcggctattgccgcctcgtgtttcacggcctcagttagtaccgttgtcagcgccaccggcttggccctctcacttctactcttggcagcagtggccaactcatctgccgctgcacaaaggaaactgctgacaccggttacagttcttactgcggttgtcacttgtgagtacacacgcaccatttacaatgcataatgttcgtgagattgatctgtctctaacagttcacttcctctgcttttctcctcagtctttgcaatttgcctaacatggaggattgaagacccaccttttaattctattctgtttgcattgctggccgcagctggcggactacaaggcatttacggttagtgtgcctctgttctggaatgcaggtttgacttcatatgtatggcttggcatgacgtcaactttacttttatttcagttctggtgatgcttgtgctcctgatactagcatacagaaggagatggcgccgtttgactgtttgtggcggcatgatgtttttggcatgtctagttgtcctcatcgtcgacgctgttttgcagctgagtcccctccttggagctgtaactgtggtttccatgacgctgctgctactggctttcgtcctctggctctcttcgccagggggcctaggtactcttggtgcagcccttttaacattggcagcaggtaagccacacgtgtgacattgcttgcctttttgccacatgttttctggacacaggactaaccatgccatctctgattatagctctggcactgctagcgtcactgattttgggcacacttaacttgactacaatgttccttctcatgctcctatggacacttggtaagttttcccttcctttaactcattacttgttcttttgtaatcgcagctctaacttggcatctcttttacagtggttctcctgatttgctcttcgtgctcttcatgtccactgagcaaggttcttctggcacgactgttcctatatgctctagcactcttgttgctagcctccgcgctaaccgccggtggcagtattttgcaaacaaacttcaagagtttaagtagcactgaatttatacctcgtgagtatctatttgttactcctgtttagttgaagaaaacaagctattggattgtaacacacattttacgctttgttccttagatttgttctgcatgttattactgattgtcgctggcatactctttattcttgctatcctgaccgaatggggaagtggaaatagaacatacggtcccgtttttatgtccctcggcggcctgctcaccatggtagccggcgctgtgtggctgacggtgatgactaacacgcttttgtctgcctggattcttacagcaggattcctgattttcctcattggtaagtgtgacaccaacaggtgttgccttgttatgtcactgttctgacacatgacttacatgggtttggcttttgtaggctttgccctctttggggtcattagacgctgccgttactgctgctactactgccttacactggaaagtgaggagcgcccaccgaccccatatcgcaacactgtataaaggtaagtattattaaattttagagacactatcacgtgtaacttgacgtgcaaggatggaggagaggggcagggaaacgcaaatgccggttgcccggtatgggggcccgtttattatggtaaggctcttcgggcaagatggagaggcaaacatacaggagcaaaggctatatgagctactctctgacccacgctctgcgctcggcctagacccggggcccctgattgctgagaacctgctgctagtggcgctgcgtggcaccaacaacgatcccaggcctcagcgtcaggagagggccagagaactggccctcgttggcattctactaggaaacggcgagcagggtgaacacttgggcacggagagtgccctggaggcctcaggcaacaactatgtgtatgcctacggaccagactggatggcaaggccttccacatggtccgcggaaatccagcaattcctgcgactcctgggcgccacgtacgtgcttcgcgtggagatgggcaggcagtttggcttcgaggtgcatagaagccggccctccttccgtcagttccaggccatcaatcaccttgtcctgtttgacaacgcccttcgcaagtacgattccggccaggtggcggcgggcttccagagggcccttctggtggccgggccagagaccgctgacacgaggccggacctccgcaagctgaatgagtgggtgtttggtggcagggctgctggtggcagacagctggccgacgagctaaagatcgtgtccgcgctgcgagacacttactcgggccacttggtccttcagcccacggagacccttgacacatggaaggtgttgagcagggacacacgaaccgctcatagtttggagcacggattcattcatgccgcggggaccatccaggccaactgcccacagctgtttatgagacgccagcaccccggcctctttcccttcgttaatgcaatagcatcatcgctgggctggtactaccagaccgccaccggccccggagcagatgccagggcggcggcccggcgccaacaggcctttcagaccagggcggcggctgaatgccatgccaaaagcggggtgccggtcgtggccggcttctacaggaccatcaacgccacgctcaagggaggagagggcctacagcccactatgtttaacggggagctgggggccatcaagcaccaggcacttgacactgtgaggtatgactacggccactatctcataatgttggggccattccagccatggagcggactgacggcccctccgtgcccctacgccgaaagttcatgggcacaggcggccgtgcagacggccctcgagctgttctcggccctgtacccggccccgtgcatctcgggctacgcgcgccccccgggccccagtgctgtgatcgagcatctggggtccctagtcccaaaggggggtctgctgttgtttctgtctcacctaccggatgatgttaaggacgggctcggagaaatggggccggccagggccacgggacctggaatgcagcagtttgtcagcagctacttcctcaaccccgcctgttccaacgtcttcattacagtgaggcagcgaggggagaagatcaacggccgtaccgtcctccaagcgctcggacgcgcatgcgatatggcaggctgccagcactatgtgctgggctccacggttcccctcggtggactcaactttgtcaacgacctggcgtccccggtttccaccgccgagatgatggatgatttctctcccttcttcaccgtggagtttcccccgattcaagaggagggcgcaagttctccggtacccttagatgtggacgagagcatggacatctctccgtcttacgagttgccctggctctcgctggagtcatgcctcacaagcatcctgtcacaccccaccgtgggaagcaaggagcacttggtcaggcacacggacagggtcagcggaggacgcgtggcacagcagcccggggtaggtcccctggacctgccgctggcggactacgccttcgttgcccacagtcaggtctggaccaggcccggtggggctcctcccttgccctatcgtacctgggatcgaatgacagagaagctgcttgtctccgcaaaacccggcagagagaacgttaaggtttcaggtaccgtgattacattgggagaacaggggtacaaagtgtcgttggatctgagggagggaaccaggctggcaatggctgaggcgctgctgaacgcagcatgtgccccaatcttggatccggaagacgtcttgctcaccctgcatctacacctggatccgcgccgggcagacaactcggccgtgatggaggctatgacggcggcgagtgactacgcgcgtggcctgggcgtgaagctgacctttggctcggcctcctgccccgagaccggctcgtccgcctccagcttcatgaccgtggtggcctctgtctccgccccaggggaattctcgggtcctctgatcacgccagtgcttcagaagacgggcagtctcctgattgcggtgcgttgcggggatggcaagatccagggagggtcgctgtttgagcagctctttagcgacgtggccacgaccccacgggcgcccgaggcgttgtctctgaagaatctcttccgggcagtccagcagctggtcaagagcggcatcgtgctgtcagggcatgacatcagcgacgggggcctggtgacctgcctggtggagatggccctggccgggcagcggggagtgaccatcactatgccggtggcctccgactacctcccggagatgtttgcagagcaccccggcctggtgtttgaggtggaggagcgcagcgtgggtgaggtgctgcagaccctgcgctccatgaacatgtacccggcagtcctcggtcgagtgggcgagcaaggtccagatcaaatgtttgaggtgcagcacggcccagagacggtgttgcgccagtcgctgcgcctgctactgggaacctggtcctcctttgccagcgagcagtacgagtgcctgcgaccagatcggattaaccggtccatgcacgtgtccgactacggctataacgaagcactggcagtctccccgttgacaggaaagaatctcagcccacgccggctggtgacagagcctgacccacgatgtcaggtggccgtgctctgcgccccgggcaccaggggccatgaaagcctcctggcggccttcacgaatgccggatgcctgtgccgacgggtgttctttcgcgaggttagggacaacacgttcctcgacaagtacgtgggtctggccatcggaggagttcatggggccagggactctgccctggcaggccgtgccaccgtggcgctgattaatcgttcccccgccctgcgtgacgctattctaaagttcctcaacaggccagatacgttctcggtggccttgggggagctgggggtgcaagttttggctggcctgggggccgtggggtcaacagataatccacccgcccctggcgtggaagttaatgtccagagatcacctctgattctggcccccaacgcctctggcatgtttgagtcccgctggctgaacattagcatcccggcgaccaccagctctgtcatgctgcgtggcctccggggctgcgtcctgccttgttgggtgcaaggctcgtgcctgggcctgcaatttactaacctcgggatgccatatattttgcagaatgcccaccagatcgcctgccacttccacagcaatggcacggacgcctggcgctttgctatgaattatccaagaaaccccacggagcagggcaacattgcagggctctgttcacgcgatggtcgtcatctggctctcctgtgtgacccctcactttgtacagacttttggcaatgggagcacattccccccgcctttgggcaccccacggggtgctccccctggacacttatgtttcaagcagctcacctatggtcactcaggcacggtcgcccctccgagtgaccagtcaccttccagactatgcatacactgaatttagcctgatattgtcccccgagccccgggcccagccctcctcagaaaactctgcatggagaagctggacgtgaacctcccccccccagacctgtgtgctgtatttacaaacactacaataaaccctatgtgcaaatgtggtttgtatggctactttgtgttcctaaaaaatgcaacaatagaagtggaaaccctcagtcacgggacattaacctcaaccacaaaatgggggttggagaaagtaaccacatatactggagatgattcatgggctgggggttcccggacaatacacccatctggagttcaacctaattacatggtagataaattaagagtccctcctcaccactcgaaactatggcagacattctataagataacgaggagagatgaggtgagggcagaggacattgggcaggtgtgggccacggggcagctggccatatcccccgcaccacagaagtgtaagcaaagtgaagggctcggaaggcaggcggggcctagcaatgtcacagctaaatgcccaccggggcacacactcaagcggggtctcggagctcccaggtcagaccacgaaaggtcagcctgcaaggtggatggcgtgttttctgaggttatccccgctacgtgcagtgctgggtgagagagaccctggaatgtgtcgaaatgaccaagcgtccccgcagcggggctcccaacacgggttcccagagagggtaaaagagggggccataaagcccagggtgtaaaacaccgatcgcgccaccagatggcacacgtgggggaaatgagggttagcataggcaacccccgcctacacaccaactatagcaaaccccgccccgtcacggtgacgtggtctgtcttgaggagatgtagacttgtagacactgcaaaacctcaggacctacgctgccctagaggttttgctagggaggagacgtgtgtggctgtagccacccgtcccgggtacaagtcccgggtggtgaggacggtgtctgtggttgtcttcccagactctgctttctgccgtcttcggtcaagtaccagctggtggtccgcatgttttgatccaaactttagttttaggatttatgcatccattatcccgcagttccacctaaacggggcttaacgttacatcccagaagatgcacgcttaaccccgcctacaaccgtgacgtagctgtttaccagcatgtatagagttacggttcgctacatcaaacaggacagccgttgccctagtggtttcggacacaccgccaacgcgctgtgcggtgctgccgtcccgaggtcaagtcccgggggaggagaagagcggcttcccgcctagagcatttgcaagtcaggattctctaatccctctgggagaagggtattcggcttgtccgctgtttttgtgcctagttttgcacccacaacatgtaagggcccgctacccctacaacacaaaacaatctcctctaaccaaccttttcccaatcaattctgtgacagagtttcctggacacccagtcttagttcagatagacacccagttatgcagtgccaccaattccaatcatttttaaacctcctggaattctatcatcaaacggcatgcaggaaaaggacaagcagcgaaaattcactccccccttgggaggtggcggcatatgcaaaggatagcactcccactctactactgggtatcatatgctgactgtatatgcatgaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctacccagatatagattaggatagcatatgctatccagatatttgggtagtatatgctacccagatataaattaggatagcatatactaccctaatctctattaggatagcatatgctacccggatacagattaggatagcatatactacccagatatagattaggatagcatatgctacccagatatagattaggatagcctatgctacccagatataaattaggatagcatatactacccagatatagattaggatagcatatgctacccagatatagattaggatagcctatgctacccagatatagattaggatagcatatgctatccagatatttgggtagtatatgctacccatgcaacattagcccaccgtgctctcagcgacctcgtgaatatgaggaccaacaaccctgtgcttggcgctcaggcgcaagtgtgtgtaacttgtcctccagatcgcagcaatcgcgcccctatcttggcccgcccacctacttatgcaggtattccccggggtgccattagtggttttgtgggcaagtggtttgaccgcagtggttagcgaggttacaatcagccaagttattacacccttagtttacagtccaaaaccgcagggcggcgtgtgggggctgacgcgtgcccccactccacaatttcaaaaaaaagagtggccacttgtctttgtttatgggccccattggcggggagccccgtttaattttcgggggtgttagagacaaccagtggagtccgctgctgtcggcgtccactctctttccccttgttacaaatagagtgtaacaacatggttcacctgtcttggtccctgcctgggacacatcttaataaccccagtatcatattgcactaggattatgtgttgcccttagcaataaattcgtgtgagatggacatccagtctttacggcttgtccccaccccatggatttctattgttaaagatattcagaatgtttcattcctacactagtatttattgcccaaggggtttgtgagggttatattggtgtcatagcacaatgccaccactgaaccccccgttcaaattttattctgggggcgtcacctgaaaccttgttttcgagcacctcacatacaccttactgttcacaactcagcagttattctattagctaaacgaaggagaatgaagaagcaggcgaagattcatgagagttcactgcccgctccttgatcttcagccactgcccttgtgactaaaatggttcactaccctcgtggaatcctgaccccatgtaaataaaaccgtgacagctcatggggtgggagatatcgctgttccttaggaccattttactaaccctaattcgatagcatatgcttcccgttgggtaacatgtgctattgaattagggttagtctggatagtatatgctactacccgggaagcatatgctacccgtttagggttaaaaagggggccttataaacactcttgctaacgccctcttgagggtccgcttatcggtagctacacaggcccctctgattgacgttggtgtagcctcccatagtcttcctgggcccctgggaggtacatgtcccccagcattggtgtaagagcttcagccaagagttacacataaaggcaatgttgtgttgcagtccacagactgcaaagtctgctccaggatgaaagccactcagtgttggcaaatgtgcacatccatttataaggatgtcaactacagtcagagaacccctttgtgtttggtcccccccccgtgtcacatgtggaacagggcccagttggcaagttgtaccaaccaactgaagggattacatgcactgccccgcgggaaatacgtcctacccaggaacccgaaacagtgtttcccagaagctgtaaaaatagaacgccctggaactgccccactgtgcaatgcagcttttagccatgccatgctctataaatcactcccctatctcaggtaggcctgcacaccttaggtatggagcgaaggttagtggtcactctgcagtgcctggtgctgctttacctggcacctgagtgtggaggtacagaccaatgtgacaattttccccaaatgttgagggacctaagagatgccttcagtcgtgttaaaacctttttccagacaaaggacgaggtagataaccttttgctcaaggagtctctgctagaggactttaagggctaccttggatgccaggccctgtcagaaatgatccaattctacctggaggaagtcatgccacaggctgaaaaccaggaccctgaagccaaagaccatgtaaattctttgggtgaaaatctaaagaccctacggctccgcctgcgcaggtgccacaggttcctgccgtgtgagaacaagagtaaagctgtggaacagataaaaaatgcctttaacaagctgcaggaaaaaggaatttacaaagccatgagtgaatttgacatttttattaactacatagaagcatacatgacaattaaagccaggtgataattccataccctggaagcaggagatgggtgcatttcaccccaaccccccctttcgactgtcatttacaataaaatgaaaccttttattcttgattgcttcttgtgttcttgccgcccaggtaccttcctgtgttctccccacgggaaaaagaatagcttctgcagaaggccattgacgcaagttttgcccgtggggattacccgacccagccacttacagcacattttgttctaggtccatcttaggagcccgggccagcattctatcagcttaacgggaagagaagtggggagggcactcgcccactaaccttaacacctgcagcctacaaaagtacactagctgtttgctctattcgccactagagaccgccaaaatgcgaaactacaggcccgggcccaggccttgcagggcagacggttaggctgacaagtggacaagtgtggcaggtgggcgggaaggggcacaagaatgccggcgaaactggaccacggtccaccccgccctcaagcgtccgggagccgggcggctcggccaaggagggcggccttgcgaacaatcattagtagctaccaacaagggcccccagatgcccccaccagtcaccccgtccgtgtccactcacatattccactcttatttttaaattcatgtgtcccaattagaaacccaagcgcagaaattagttgagaggctagtgttttaaacatgcactctaggccagccagagataatttcacaagactatcaagttggtgtaaacacgccgtgggaaaaaatttatggttcagtgcgtcgagtgctatctttggaacagtagaaaattgaaccttgttggcgggagaaggcataacgccttatctgggaggagcgacggattatagccaataagagagctcaagacgcagggctcgcaaagtatagtggccccgtgggaccttagaggtggagcaacgtctaaagtggtaataacaccaggcggggctgggcaaaggggtcctacgggcgggattaattacgccttgcttacgcaagctcagttaattcgcccacgacttgaaaaatgtagcccttaaccaattggcggcccctaagggggggactaaggtcccactacaaaaactctgtgttcttctgcaaattttagatcagatggcatagagacaaggacaccgaagacccccagagccctcatcgcagggttcttaccatgtggccatgtaggcccacttaacactacaagacctacgcctccccattcatcatgtaacccgcaaatcatctaaaccgtaagtctaagggcctcctgaggttttctcaggaggccctaatgtataattaatcatgcatttgatttaaaaaaagtaggttatactcattttaggccagtctttatttgcagattaataatttatgtgattctccttccctctaggactgaagaaacagcctcctgcacgtgagcatgtatctgaaataattattatgtcataagtgtaatgatgagaaagtcataaacccacttccctttacatgaatctgggcactgaattttggggtacctctaaagactaacgtgttcgatttcggggtcacttccccttttataagtgtgtgaacagtgatttcagtaaaacctaagagatatttggtgtcacttccgcattttaagtttcagaaaattttaaaattaaaattgaaatttctctcaaaataattccaatgaaaacttcaaagaatcttatgtatataattcttttgccccaaactgggcttcagatgccttctattgcactctcacaaaaacattctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccaccggcccttctctctgtccccctgctcctctccaaccttcgctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagtcccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacggtggacaggccctctgtccacccgggccatccccgcccccctgtgtccaccccagtcccgtccaggggggactttatgtgacccttgggcctggctccccatagactcccatgtaagcctgcctcgagtaggtgcctccagagccccttttgcccccctggcggcccagcccgacccccgggcgcccccaaactttgtccagatgtccaggggtccccgagggcgaggcccagccccctcccacccctgtccactgccccggtccccccagaagcccccaaaagtagaggctcaggccatgcgcgccctgtcaccaggcctgccaaagagccagatctaaggccaggagaggcagccccaaagcgggtgcagtaacaggtaatctctggtagtgatttggacccgaaatctgacactttagagctctggaggactttaaaactctaaaaatcaaaactttagaggcgaatgggcgccattttgtccccacgcgcgcataatggcggacctaggcctaaaacccccaggaagcgggtctatggttggctgcgctgctgctatctttagaggggaaaagaggaataagcccccagacaggggagtgggcttgtttgtgacttcaccaaaggtcagggcccaagggggttcgcgttgctaggccaccttctcagtccagcgcgtttacgtaagccagacagcagccaattgtcagttctagggagggggaccactgcccctggtataaagtggtcctgcagctatttctggtcgcatcagagcgccaggagtccacacaaatgtaagagggggtcttctacctctccctagccctccgccccctccaaggactcgggcccagtttctaactttttccccttccctccctcgtcttgccctgcgcccggggccaccttcatcaccgtcgctgactccgccatccaagcctaggggagaccgaagtgaagtccctggaccagcccggcccgggccccccggtatcgggccagaggtaagtggactttaattttttctgctaagcccaacactccaccacacccaggcacacactacacacacccacccgtctcagggtcccctcggacagctcctaagaaggcaccggtcgcccagtcctaccagagggggccaagaacccagacgagtccgtagaagggtcctcgtccagcaagaagaggaggtggtaagcggttcaccttcaggggtaagtaacctgacctctccagggctcacataaagggaggcttagtatacatgcttcttgcttttcacaggaacctgggggctagtctgggtgggattaggctgcctcaagttgcatcagccagggcttcatgccctcctcagttccctagtccccgggcttcaggccccctccgtccccgtcctccagagacccgggcttcaggccctgcctctcctgttacccttttagaaccacagcctggacacatgtgccagacgcctgggcctctaaggccctcgggtccccctggaccccggcctcagcaaccctgctgctcccctcctgccaccccagcctccccccctccccgtcccccttcgctcctgatcctcccccggtccccagtaaggccgcctgtccccctgcacccagtacctgcccctcttggccacgcaccccgggccaggccaccttagacccggccaagccccatccctgaagacccagcggccattctctctggtaacgagcagagaagaagtagaggcccgcggccattgggcccagattgagagaccagtccaggggcccgaggttggagccggcgggcacccgaggtcccagcacccggtccctccggggggcagagacaggcagggccccccggcagctggccccgaggaggcgcccggagtggggccggtcggctgggctggccgagcccgggtctaggaggtctggggtggcgagcctgctgtctcaggaggggcctggctccgccgggtggccctggggtaagtctgggaggcagagggtcggcctaggcccggggaagtggagggggatcgcccgggtctctgttggcagagtccgggcgatcctctgagaccctccgggcccggacggccgccctcagccccccagacagaccccagggtctccaggcagggtccggcatctccaggggcagcaggctcaccaccacaggccccccagacccgggtctcggccagccgagccgaccggccccgcgccgggcgcctcctcggggccagccgccggggttggttctgcccctctctctgtccttcagaggaaccagggacctcgggcaccccagagcccctcgggcccgcctccaggcgccctcctggtctccgctcccctcttagccccgttaaacccaaagaatgtctgaggggagccaccttcggggcccaggccccagagtccagaggtcaggggcacctcagggtgcctccccgggtcccaggccagccggagggaccccggcagcccgggcggccccagaggccggttcctcgccccttccccgggcttcagagcccaggatgtcccccagaagggaccctaggcgtcccctctcctcccctccaggctcgagcctctccctcgcggagaggggcctctttgggccctcacgtccagccccaccgagacccgagtggcccggatccccccagcggcccttctctctgtccccctgctcctctccaccctagaccccagcttctggcctccccgggtccaccaggccagccggagggaccccggcagcccgggcgagtcgccttccctctcccctggcctctccttcccgcctcccacccgagccccctcagcttgcctccccaccgggtccatcaggccggccggagggaccccggcggcccggtgtcagttccccctgcagccgcccagtctctgcctccaggcaagggcgccagcttttctccccccagcctgaggcccaggctcctgtgcactgtctgtaaagtccagcctcccacgcccgtccacggctcccgggcccagccccgtccacccctccccacgttggacaggccctctgtccacccgggccatccccgcccccctgtgtccaccccagtcccgtccaggggggactttatgtgaccattgggcctggctccccatagactcccatgtaagcctgcctcgagtaggtgcctccagagccccttttgcccccctggcggcccagcccgacccccgggcgcccccaaacgttgtccagatgtccaggggtccccgagggcgaggcccagccccctccctcccaagctgctttgattcctgggatatttttgggaatggtgttaactttctccccttgtatttgctattcaatcaacctgattccccctgctcatacctccacttacaaccaagccactacggccacgtccccggcctcccgctcgggtaagtgctttttcatttttatccccagcccctcctctataagttctaggcaaacctccaatcaccagccaccttccaatgtagtctcttagagagtggctgctacgcatgagagccagctttgagccacccacagtaaccacccagcgccaatctgtctacatagaagaagaggaggatgaagactaagtcacaggcttagccaggtgatttgtgaatttcagtttatttactttcttccaatcaagctttcccagcctccgcttgttaggtcctagttatgggttttccatgggggacttagtatccgttctattagattaacgtgcaagacgctaaacttaaccaagggcagccaagggacacgtgttatcccaggctgcccaccctgaggatttccccccaaaatcctcctaccctctctttatgccatgtgtgttgttggcgtgtgttagtgctatgtaatgcggtgccgccaggtggcagcctgtttatagatgtgcagtaccccttaatgttaggtctgctttagggctgccaggtggcgcaatctaggattaatccacctgtatccctttccctccacccgcagtaacccagcactggcgtgtgacgtggtgtaaagttttgcctgaacctgtggttgggcaggtacatgccaccaaccttctaagcacccgcgcttgtgttttgctttatctgccgccatcatgcctacattctatcttgcgttacatgggggacaaacatatcatctaattgttgacacggatagtcgtggaaacccgtcactctcagtaattccctcgaatccctaccaggaacaactgtcagacactccattaattccactaacaatctttgttggggaaaacacgggggtgcccccaccacccccaccacccccaccacccccaccacccccaccacctccaccaccttcaccaccttcaccaccttcaccacctccaccacctccaccacctccaccacctccaccacctccaccacctcagcgcagggatgcctggacacaagagccatcacctcttgatagggatccgctaggatatgatgtcgggcatggacctctagcatctgctatgcgaatgctttggatggctaattatattgtaagacaatcacggggtgaccggggccttatgttgccacaaggcccacaaacagccccccaggccgtgttggtacagccacatgtcccccctctacgcccgacagcacccaccattttgtcacctctgtcacgaccgaggcttacccctccacaaccactcacgatgccaccaaggcctactcctcctacccctctgccacctgcaacactacttacggtgccaccaaggcctacccgtcctaccactctgccacccacaccactactcacggtactacaaaggcctaccgaacttcaacccacaccatcaccacaaagcatgcatctccctgtcttgcatgtgccagaccaatcaatgcaccctcttactcatcaaagcaccccaaatgatccagatagtccagaaccacggtccccaaatgtattttataacattccacctatgccattacccccctcacaattgccaccaccagcagcaccagcacagccacctccaggggtcatcaacgaccaacaattacatcatctaccctcggggccaccatggtggccacccatctgcgaccccccgcaaccctctaagactcaaggccagagccggggacagagcagggggaggggcaggggcaggggcaggggcaggggcaagggcaagtccagggacaagcaacgcaagcccggtggaccatggagaccagagccaaacacctccagtcctagcatgcctgaactaagtccagtcctcggtcttcatcagggacaaggggctggggactcaccaactcctggcccatccaatgccgcccccgtttgtagaaattcacacacagcaacccctaacgtttcaccaatacatgaaccggagtcccataatagcccagaggctcccattctcttccccgatgattggtatcctccatctatagaccccgcagacttagacgaaagttgggattacatttttgagacaacagaatctcctagctctgatgaagattatgtggggggacccagtaaaagacctcgcccctccacccagtaaaaaaccttgccctctccagcaaccaatgtatcccaaataaatgttacttcttttgctcttgaccattgacacgcctgtcattctatcaattaaacaagggaaaaaggtttagctattccaccaacacgaccccaaggaaggcttgccaaaattggggccttgctctcagcactttgccagcaacttatagcatggtaggcagctcaactcggcccgtcttactgcccagcctactctccactcccagtccatgttcgcactcctatgcatttccttccctcccacttttaccccagtcccaacccaaaaccacacacaacacatagaattgttagtttaaacagtttattgatacatggctgcttttagcctaattgtgtattgctctcgttgccaaaacctggtgtaagggccggcacccgcaacatggggaaaacataaccgccgccatcccatggggagggtagaggcggttgacatgtaggtgagtagtgtaagaagcatggcgaagtagacaggttacttttagagtgtagtgtacagggccgggcgcaacagtgccaccaacccggggtctgagcattccatgggcagcagggacactgcactaccgccaggtccaggggcagccggggttcctggcgctccgggggcagccgggcggtcgccggtgggtccactgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgcgggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgctccgggtggggggtggccccgctgggcaccgctgcgccgccgccaggtcctggggcagccggggttcctggcgctccgggggcagccgggcggccgccggtgggtccgctgggccgctgccccgccgatccctcccccccagggcgtacccggcttgcctggttctggggctcctctgggggtcgctgcatccgccggtagggttcgaatgggcgtggtccgcttgctctgctggcccggtacgcctggattgccggctgggggctggggtcccgggacgccccctccctgctcccacccggttccctcccccagggcgtgccccgcttgcctggtcctggagctcatccggggatgctgcatccgctagtccgacctgggtgggtgcggtccgctggccccaccctgggggtcgccgccgggtccgctggtccggtgcacctggaaggcagggggggggggggcgtaagggaggggcgtggtcctgggaccccgcgccgactggcagggggtccccgtggcacagggctaggggtccggggggcagccgcggcccagcgcaccccgttcacgggggaggaccgcggccgagccaccatgggcccggcgggggtggggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccagctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccattatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccgggggcggaaggggacttggggtgattttctatgtgggggtggaaatatgagcaagaataaggacggctccttattaacctgatcagccccggagttgcctgtttcatcactaaccccgggcctgaagaggttgacaagaagggtcaaggtttcgtctgtgtgttgaagggcaggggctgttgggtgcatctggaacggcttacctcgggtaactgtttgccattaaaaggttggggattaggtttagcccctttagctgccatttcgaaccggggtgtgcagatgcaggtctccgggtgggcaggcagtacgagatgtcacgttgtgttgtctttcctcccacccctgtcctggctgtggcaaatgcgaccctcatagagttgtgtttcaggtctgtgtcctgttttgcggtgggttatttcccccctcagtgttcgccagcttatttccccagtccccacgtactggggcctgtggacacctgagggagcggccgttggtgggcatgtgttggaattgctcccaccctcaattttcgcttgccttcttcccttgttaacctgatagcatagcctctaggtttccttgtaggtctgtttgggtttgttggttcacgtggtgctaacttgaattttttggttttctagttccctcttaattacatttgtgccagatcttgtagagcaagatggcctattcaacaagggagatactgttagccctgtgtatacgggacagtcgtgtgcatggaaatggtaccctgcatcctgtgttggagctagcagcaagagaaacacctctccgcctttcaccagaggacactgtagttctgcgttatcatgtgttgcttgaggagataattgaacgaaattcagagacatttacagaaacttggaacagatttataacacacaccgaacatttggacctggattttaactcagtatttttagagatatttcaccgtggagacccaagccttgggcgcgcgttggcctggatggcctggtgcatgcatgcctgtaggacattgtgttgtaaccagtctactccttactatgttgtggacctgtcagttcgtgggatgttagaagccagcgaaggcctggatggttggattcatcaacagggcggctggtctacattaattgaagacaacattcctggatccagaaggtttagctggactttgtttcttgctggactgactttgagtctgttagttatatgtagttatttatttatctccagaggaagacactaatctatacattttctcagcactttatatgaatcagggtcattgggcctgcagggaactgagccagtaggatattaggcaagggtgacacagtgcccatgcattataatttaaccaaacagtggtcgtgagttttaggccggccatgggggcttacaagaataacatgccaatgacccggcccccacttttaaattctgttgcagcagatagctgatacccaatgttatcttttgcggcagaaattgaaagtgctggccatatctacaattgggtgtcctaggtgggttatacgcctgtggtgttctaacgggaagtgtgtaagcacacacataatttgcaagcggtgcttcacgctcttcgttaaaataacacaaggacaagatactaaagaaataactgaggtgagtgtgggaagatgggactacgatgtgttatgttaacgggtgagagcctatactgcagcccagactcggggggaggaggaaatggtaagagttatactctacttatcttttttgacactacagttaactgttatgtaacaatgtttgcttattttcatgttcaataaacgctatgttaatgatgaagaacctgtgttgttctttggaagtgggcccgatggggtagtaggttttgggagggtgccgtgctagatatttcaactgccacagaccccattttgtcccacctgttaccacattctaggtcctgcatccagtgggccaggtgtctccccatggctctttctaggtggatcccacagtccaggcccccaaggctaccgtgctaattacctcctcatgtccacccccaccctgtgttactgtcgcctgattatcctggcttagcagcctccaagttttacaagacgtcccattgccctgcccttggtccaagtctcgccggttttcagcagcctgttgtagcctgcccccaagtttcgcaggtttcccccatgcttccacccgttaacccaatagcatgacagccaatccaacacgaggcaagtttcaagagttaaaagcaactactgtttattttccaaaatgagctgggtatagttgatgatctgtaggcgcagctcatccccacattccaggtccttgatggcctcgtagatggcatcttcgtcgacattgacagtcttctcatataccgtgtctctggggctgacctttatgcagaaggcgtcccctactaggtccacggccagctcgtaggtggggcctatgttttcacataacagtttcaagcaggtctctgggatgtgaagggaggtgccctggagcaggagatgcatgattaggcgcccttttccatttgtgctgaagatggggcagatggtgccacaaaagtgtccggtgaccaggtaagcgtagagaaggctgggttgggaaagtccagcctttactgcactgggagagctgctgagcagagacacatagaaggtcttgttgggtattatcttgtggacattgttgaagaaggagagctgggtggagctaaactcctgaggcacatgaacctgggacctattgatgcagatctcgcagtgagaccccagagtcaggctgtggccgaagggagacaggcgaaggcagcgcccgggggagagagtgcacagtgacagtgggagaaacacggcctctgagacatgtatgggggtgttcatctcacgcagaaaatctttgcccagctcaaagttggcagagattcccctgaagaagtcccgtagtgaaaaatgggatctgtctacaccatgtctggtgtgccgggaacatattgagcgggccacactgccaaccctttccattcttcccagctctgagcgagattttccacacctggacaccgacttcacgctatgtgccgaggcttttgaggccgtatagtttctgtggtgcggatgcattaggcggcgcaatgtgggatctgccggccgctgtcggcgtgcatccacggcctctggggtgaccggggccatcggttttacttttcacacgtagacctgggaagtttgataggactgtaccaggtcaaggccgtggatgcgcaggaccacgtccagttccttagtgacatccacgaggattgttttgcccactctggccacttgtgtggatttaaatatgtacacaagcgtaattaacgagtcacagaccccctgttccagattctgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggggtcggcaccagtttctgggacaccgccacaaggacaaggtgggctagcaagttctcgagtctatgaagactccgggggcagttttttgagtttctcgcctatgatccaccccaatctcgcccccataattgcgccatctgcctacgcgaggctgaacctcctgaatcactgcatctttctcgaggcgtttaaagaagagaatagtggccagggcctcggtggggtccagcgtgaggtcttatttttgaaaagggatattataaaacaggtcattgctcggattgtggcagccgatagcaccctagatctagtgaatcatggcgagcccggaagagaggctcctagacgagctcaataacgtaattgtgtcatttctgtgtgactctgggtctctggaagtggagagatgctccggggcgcatgtgttctccaggggcagctcccaacccctctgcaccgtgaagctgcgccacggacagatttaccacctggagtttgtctacaagttcctggcctttaagctgaagaactgcaactacccctcctcgcctgtgtttgtgatatccaacaacggcctggccaccaccctgaggtgctttttgcacgagccgtcgggtctcagatcgggccagagcggcccttgcctgggtctctcaacggatgttgacctaccaaagaactccatcattatgctgggccaggatgacttcattaagttcaaaagccccctggtcttccctgctgagcttgatctcctgaaatctatggtggtctgccgggcctacatcacggaacaccggacgacgatgcagtttctggtgtttcaggccgccaacgcccagaaggcctcgcgggtcatggatatgattagtgatatgtctcagcaactgtctcggtctggtcaagtcgaggatacgggcgccagagtcacaggtggaggaggtcccaggcctagcgtcacgcactcggggtgtcttggggactcacacgttagggggcgcggtggttgggacttggataacttttcagaagctgagaccgaagacgaggcgagttacgctccttggagggacaaagactcgtggtcggaatccgaggcggcgccgtggaagaaggaactcgtgaggcaccccatccgcaggcaccggacacgcgagactcgccgtatgcgcgggagccattcacgggtggaacacgtgccccctgagacccgggagacggtggtggggggagcatggcgttattcttggcgcgccacaccttatctggcacgggtgctggcggtcacggccgtggccctgctcctgatgtttctgaggtggacctgacgttgccggcccttgaggagcgggagttctccaggctcctggatctggggctggcctgcctggatctgagctatgtggaaatgagggaatttgtggtttggggcaggcccccagcttctgaggcggctgtggcctctacgccaggctcgcttttccgaagccactcgtccgcctactggttgtcggaggtggagaggcccgggggccttgtccgctgggccaggtcacagaccagcccctcatccctgaccctcgcgccccatcttggcccgtccctcttgtccctttcagcgttcaccggtggtgggtgtggagccgtggccttttgcaacgcctttttcctagcttattttttggttgtgcggtctgttttccccgcgttttccgatagaatagctgcctggatctgcgcccggtcccctttctgcgaaaacacccgggccgtggccaggggttaccgaggcctcgtgaagaggttcttggcattcgtgtttgagcgtagtagctatgacccccccttgttgaggcaaaactctaggcctgtggagcgctgctttgccatcaagaattatgtcccgggcctggactcacaaagctgtgtgacggtcccgagcttctcccgctgggcccagtctcacgccagcgagctcgatccccgggagattcgcgacagagttacaccagcgactgcaccttcgttcgtggctgatcatgcctcggctctattggcctccctccagaagaaggcctccgacaccccctgtgggaatcccattcagtggatgtggtaccgcctgttggtaaactcgtgcctgaggagcgcccactgtcttttgcctatacctgccgtctctgagggggggagaaagacgggcgggggcgtaggggaggagctcgtgggggccggggggccctgcctgagccgggatgttttcgtggcgatcgtaagccgcaatgttctctcgtgtctgctgaacgtgcctgccgcgggtccctgggcctacaagtgtttcagatccctcgcctccagaccggtgtctggcccggattaccctcccttggccgtgttttgcatggactgcggttactgcttgaactttggaaagcagacaggtgtaggaggcaggctcaattcctttagacccactctccagttttatccccgtgaccagaaggagaagcatgtgctgacctgccatgccagcggccgtgtgtactgctccaactgcggctctgcggcggtgggctgccagaggctggctgagccaccgagcgcccgctcgggctggcagccccgaatccgggcggtgctgccgcacaacgcggcctatgagctcgaccgtggctcccgcctcttggatgccatcatcccctgcttgggacccgaccgcacatgcatgcggccggtggtcctgcggggggtgacggtcaggcagctcctgtatttaactttgcggacagaggccagagccgtttgctccatctgtcagcaacgccaagctccagaggacgcccgcgacgagcctcacctgttctcctcctgtttagaggtagaattgccacctggtgagcggtgtgcgggctgccgtctctatcagacgcgttatggcacgccggctgcccaagcccaccctccaggggaggctggaggcggattttccagacagtcccctgcttcctaaatttcaagagctgaaccagaataatctccccaatgatgtttttcgggaggctcaaaggagttacctggtatttctgacgtcccagttctgctacgaagagtacgtgcagaggacttttggggtgcctcggcgccaacgcgccatagacaagaggcagagagccagtgtggctggggctggtgctcatgcacaccttggcgggtcatccgccacccccgtccagcaggctcaggccgccgcatccgctgggaccggggccttggcatcatcagcgccgtccacggccgtagcccagtccgcgaccccctctgtttcttcatctattagcagcctccgggccgcgacttcgggggcgactgccgccgcctccgccgccgcagccgtcgataccgggtcaggtggcgggggacaaccccaagacaccgccccgcgcggggcacgtaagaaacagtagagggcacgaaacatggtgtatgcactttattaataaacaattacagatacaaaaacttgagtctctcgaggtctgcgatgaggcggtgggtggaacgctccagcttgcggcgaagctggctcacgaagcgagacaggactcggctagcctgactaagggtgaggctataacgcaggtcctgttccggagcggcggtggatagagaggagggggatccggaggggaccactaggtcgccggaggtcgaccctcctgtcaccacctccctgataatgtcttcaatagacagaaattgggtgaccactgagggagtgttccacagtaatgttgtctggtcgctagatggcgcgggtgaggccacgctttgcgaaaacgaaagtgcttcaaaaggcgcgggatagcgtgcgctaccggatggcgggtaatacatgctatccttacattttggcattttgggcagctgggaggcggcggatgggggtgcttctttttgcacggtgtatgtttggggacccgcatgccggtactgggataggcgcacctcgggccgcgcgccaggctccgagccggaatgcattgggggcaatgggattgcgggggattgttgctgtctgctcctgacagggagagacacgcgcggcggagatgcagccgacggcggggccgcggtgggctgcccccgaggacgggcgccggccgccagcgcccccgtggcctttggcacgggcctggcccccaccgctttaattgtgggggtgggcagggcagctgcatcttggggcctctgtgcttgcgttttttgggggcttggtgccaatgcaccaactggggtgtgcgcgggggcggccaagccggaccccagggcgggtgcctgggggatgggaaggccggacggcgcttctcccgggtcgaacgctggagtagcggaggctgctgcgccggcggccaccacgggcgcacggggtcgcagcccgacggccgtggggaggcgggtggcggagggccgaatctccgcggcttcttcccggcccccctgctgtttcttctcccgttgcatgatagaatggccatagggtgggtcctgagaggaggcttgtgtgtcctggggctggagcccaaaagtcgttaaagatgccgctgatggtgtgggagctatgcctcccgtcgactggccgggcttgtagggggctgagggtgaataactgggcttctgtgaaggcaccaaccctggaatctggatggtatgtttcttctgtgaccccgaggcagtcgatggtgtagagtgtggagacaatgtgtaaacgatgggctttgaggggggctgttgtggtgctggttggggaaggagctccagggaatctttgggccatggccttggggaccttcccggagaccggtctgggctctcggaagccctcgtttcggccccgaaatagggccttgccatcaatcgggggcctgggagagtgatgggggcggccaatcccggggtaactgtcacgtcccggggggaggaggtaggagacagccagtccctgggcctgcctggggccaccttctctaagagagggctctgtgggctgggagggccagaggcctcagattcagccgtagtgctccccttttccccctggtctgtctcccctcctcccaactgctggagccggtcggaggaggccggggtgttatctgctgactgaaacccgtccccgctgaccagtccgtgccccacccttggggggaaaccggagaacagctcctggacgttgcgtggattcgggggaagctggtatccaaccggcagtggaggatcttcgtgctcgtagaaggaggggttgagtacatcggtcggccatcgtgaggccccggccgcgttaaagtagaactgcacgtttggcagattgtgccgataggtgaaacacttccagatgatgttttttctgttggccaggatggccacggtggggggcctggcctccttaggtttggcggccctggcctcggtgagaagctcgcgtagccacacggcctggcgtgcaaagatggacatctccggctcgaaagactcggagtagccgtccaggtcctgcagaaaattcagcgagatggtctccaccagggaccggaagggctcggagtgcccgtcgcagtagaggaggggagcaacgaccctgacctgtcccagggtcttcaggttaaacagatattgagaggagacaaagagagttaggggccgaccgaggaaggccgccgccacggccgcctcaaaaacggagacggggatggtgtcaccggagcccctcttaggaccggtaatgggagtgccataaggcataagatttctcagggcccggccggtaacggtgccgtaggaagacggggtttcgcgggggacctcgagtccctccgccctgggaagctcttctccgcgtgtataggcctgcttcacaaagtcacgcaggtagtcctgaaacgcgaccgggccctccagcgggcgcaatgagtgccagagctgctgaagggcctcgggggcgaagcaccggcgtgcgaggagcagcatgcaggctcgggcgcgggccgtgctttggttgtggaccaggcccaagaactcggggtgcggccagagggcggcccgggtatccatctcctcccaggcgtcctggaagaagatgaagccggtgggtggaccggcgatgcggtggcgggtgaggcggcgcgcgtcttccccgtcgtcgctgccgcgggtggttgagggcatgccccccctcccggaggctggactcctgaccagcctgtaggtgaggaccgagtccgacaggaggtctcccaaacccccatctctcgctagagccgagaccaggccgagtcctgcgtagaacgatggggcgcccaggaaggcggcagcgtaggccggatgtgtgccgaccagcagcgccattatctcccgttgttccaatagaataacttcccggtctgtggccggggctggataaggggggtgattcctagaggcgatgagactggcgtgcgctaaaagcgtcatggccacaatggggttgtctgccaggtcttccatcagggctttgggcgcagagacgtattcccgaagcagctccccggcgttggactccacgtcgggccaggtgtcccagtaggagtcggcggcggcggcgctgaggcgggcggaagctacactggccagggttcttctcctcctctcttggtcatcctgcgggggaccaatagcttgggggcgtccggctggggtcagggaaaaggcctctgggttctccagcacggtgggcatgacatattccagaaagttgtggtagacggggatgtagttgagcggctcctgggtgtctgcggagacgtaggccgggttaagggggtcgcagggagactctgtttccagccagagggtgccggcgtatttcgccggccctgccgccgccagaaattgtgcccgccgggtcggggctccattgccccatccagttggtggtgccgaaatcgtgatgaggaggggcaggttgttggtcaagggatgcttaacgaaaacggtaggctgggcggtctcgtaaaaagccaggaaactctgcttggccgaggcatagcgcagcagcttgtccttgaggagtgcatactgggagccagccgaggccccaagcgccaggcccctggcagcctccaccacgatcttgagctggcgcgggtcggtgtggcccctggcctgggtgaccaggtcctgcagcgttccctgcagctgggactcttcctgggcctcctggatgatggcctccagtcgggagaggcgccttttccagtctgcgaaggtctccttgccccccgcgacccgcttggggtccaacgtggccagagccaacctcagctcctccatgccatccatggaattctgggccatgccctcgacttccaggagccgtgttagctcatgaatttcaccgtcagccgcagcggctaggttcagccaggcacccacacccccagctaaggccagggctccttcggaaagaccccgcacggcctcgcagatgccccggatccacttggcggctgccagggatttccggtagggccacgagccgttcccggccgctgcccgggccagggcggcctcgaggggagcctggacaggggctttgggcggggaggggagcaggctccggagttcatcgtcgggggcttcgtcgcgtgacctggagaggacggcctccagagccgtgtgaaagccccgccgagtgcttgccgccatctcgtgggccttcgccatcagggtctggctctcccggacctgctcttccagcgcccggacctcggccgcctcggcctcggtcagcagctccgagaagaagtcccccgtggcctggaggagatcgtcccgctctcgccttgtcagcagctggggtttcttaggccagagtgccgagtccgaggccagcctgggcggggcggttgcctgggggatagttggaggaggaggcaggttagcctggcctgggtcattagtggcttcgggtagcgtccgatccacgtactcgctcacgatggccgtcagggcagcctcggctgatcgtcttttttccagaagcccggccagcccccgctcgtactccgcgtagggggcctccagatccgtgttgaccaccgctgatttcatgtccggggactgcagggcctggcgcgtctgcgcgagggccgaacggatggcatcggccgccgtcctggcgcgaaagagggccccggctgcttcctccgctcctcgccctcctcctccttctttggcggtagccgcgggggtggcgggccaagcgtccagtctggccagagggccggtctcgatctccgtgaaccagccgggttccgcagcctccattctctccgccgcaccaccatcgtccacgagcagggattgcagtctctccctcctcaccctcgttattcccaatagcatagcggcaaggatctgtgtgagggagtccaagatgtccgtgtttctggctactgccgccgctgctgccgcggctgagtccgtattgtctggcagcagggaggccagcagggtgttccagtcatcgggcgaagtgggagcgggctctgggcgtgcccccagcgccttcctaattctggcccaggcctcattcgcctctcgcgctcgccgctcccgcctctccttgtcttcctgttctcggagcttctccttttccttgcgcccggtctccataagctgccgcagcttcttctcatactgtcgcttgagctctttgttgggggcagtgtccagaaaggcctcgagctgttcctcggtggcgggcttaaagccttcggcctccaggcgccaggcctgcacctccttctgtctgagctgatcgttgttgttattcttcaatttctgcaggtaacttaggaagcgtttcttgagcttccctgggatgagcgtttgggagagctgattctgcagcccagagagtagtctcagggcatcctctggagcctgacctgtgaccgtcgcatcatagaccgccagtagacctgggagcagattcaccgccgcggccgtctcctttaaggtgctgtgagtagcaaaattctgcaaggccactaggcgcgctggctccagcgtcagccggttgcccatctcgaatgtgtgcagggcctctgagaccatggggtccaggatgcggtcaatgccatcctgcacctcagggtcaaggaccggcaagtcacgatagaggtggtctatgctctcctcgaaggaggcaatgtagttatcgatggtgtagaaggtgatggatttcaggatgttcatcaggtacttcttggagcgaacaatctgctgtatagtgtcacgtaggcggatgtacgtggggttctttgcggccccgactatcgaccctgcatttgcgatgtacttttctatgacggggatggtgagggccgcggtgtcggccagcggtggcgtggcttcggggttgtcgtggttggcgggtgtcgcagagggagaggcgggagagatgggggcgcctggggccgaggccacaccggccaggcccaacattgcctcgatgtcgtccaggatggtgcggaggcgcttttcgttttctctggtggtctcgagctccttctgttttttcgcgactgtctcaaactctggaaggggggcaatgctggggtcgtcctcctcaactcgctccaggggccaggggataccgctcatatcactaagggcggtgcccaggtagaggagctcgcgatagtcccattcaatggacgtgtaccggatgtttaggagaggcagggaggcgatgatctggcatgtgtgccgcaggtgtgtcaggaggtcgtcaaaatccatcaccgttgggaggcttgggtcctcaaggtaggagagataatcggaggccgccgaggccaccttgtccctgatgtccgccgtacacctgcgcacgtgcagggccgcattcttggaccggacggccacgttgtggacaaaggggggcactgaggcggcgggaggggccccatactctatcgctgtcaacagcgccaaaaagcggacgtcctcctcatctaccccagcctgttgtctggccacggccgttcgggcggcctccgccagggataggaggcgcttccagctctcgtcgtccaggaccaaggggacgtccacgtgcgggcccctgtagatggaattatcctcgggttctcctcctccttctcccccctcctgatctccgcccgagagcaggtcggtcaggcgtctgcgggccgcctccaggtcaaattttccatcgtcgctctcggccagctggggaatttcagccagcatcttagcaccggcatctacacggaccgcgtccttcgtggccagggacggcaggcaggcctccagctttgcggccaggtgctcatggaactctcccgctcttcccttgttttctgatagcatgtttgcgaggttttggatgttaagttcggaagtgagcagttgctccaggtccagcgtggggacctgcagatgtcccgaccagtcctttaagaattccagcagatttagcacagcagatcggtccctactccttattagcccctgctcgaggaccactgtcacaagaagatagtctatcatgctcaaggcatctgcctctggcacttcccggttagaggccgggtcgtagacgatggcctgttcctggtaggtatgtccggctattctcgcaatgttgctctcgaggggcacaaagtccatctcaggagtctctatgtcaaaggtggtctgatagtattggctcctggcggtgtccagtgtgatgggggacgtgggggcactggatcccgattccaggctgttggagaacacttcatcttcgaacatgtcttcatcctctgtggtggggatatcggaggctaagtcgctctccgcttcttcagagtcggacatggataggaaaggttcctctaggtcagacaggtagcggacgaggccagcacccccagatgcatcttccccaaaggagggctgctgcccgaagggaggtgatggggatatctccgttccagccctgtcagcggccgggggatggtttttttctggttcgagtgtcgtggctgatggtgggatctgctgagcaggaggaggagccggggtagctgatggcaggggctgctgctgaggaggaagaggagaaggagcccgggcggctgatggcgggggctgctgctgaggaagaagtggagaaggagccggggcggctgatggcgtgggctgctgctgaggaagaagtggagaaggagccggggcggctgattgcgggggctgctgctgagttggaggaggagaaagagtcgtggtggtgggggctgctgctgcagtcggggaaggggatggggtggtcagagggatttttgggttcgagggagctgcctgtggcagagggatgggtatttgcaaagggaggcgaggagatggagtgactgaaggagcgatagttgagactggtgcggggtggggtgtcggggaggcgggtggtgattggtgagggatggggattactggagggggaaggcgagctgctgaaggggggcgatggggcggaacgtgggtgcgtggcagctgatcatcctctgtgtcagtggtggaggacagagggaggcggcggccggaggtgggcttcttgtgggggctatctttgcccaatccctttttcctcttgggagtctgaggcgctgcgccgcccgacgcccttggtggcgtggagggagcggggaccccgggggtgtgacctaggccggggatggggatgaagaggggagggctggaggccggggccgcggaggccggggccgcggaggccggggccgcggaggccggggccgcggaggccggggccgcagaggccggggccgcagaggccggggccgcagaggctggggccgcagaggccggggccgcagaggccggagacgacggcggggagttggtctttgcaggactatacctggcggcagggaatgagtcggatgtgaaagatcgagagggcagtggcctgaggttatacggtattattcgccgttcaaacggtagcatgacgggagggctgctatcagcaccgggcgtccccgccgcctccccatcactggacacaagctcgggccccaccaggtcaaagccgctgccgttggcctcataaaagtcatacacgccatagtgttccagcataaagatgcgggggtcctctgtctcaaaggcctcgggtagaaaatagagatgcacgcaagtgtactgggcccctggtgcccccacgtactgcaggatgtcgtgcgcataggtgctgactctgacatgggcgggggtgcccggggccgcatccttctggcagtgggggtcaaacaagtagaaggagccatctgtctcgatgatgatggcccccgcgtagatgtcgcagatgtagaggatgaactgggccaccccgttgtaactgccgtgcaggacctcggccagggactgaacaactgccgagtttgcgatctgggcagggaataggacgaggccaaagatctccgccgagcggtatatgtgcacgcgcccaccgcccctcaggaccacggagctgggcacgtccgtcaactgggccatctcgtgccccttgaggatgccgctctggcgcatgagggcatccagccgcgccccctcgtccaggacctcgtccagctcagggcgggaggtcagggggcggccggccaggaagcttttgaccaggtagaggacgcagttgctgacgcactggatgccggcaaagcggccaaacttgcagtgggcctggttgcacgaggccgtgcctaggatgcggagggccgagcctccactcccgcccccgggggcattcacatccatggtcctgattccgcgcacggggccggttccccgggggcgctggctttgcccccagtcgccgttactcatcttcggtggtgggacggggaggacgccttgtcgccccccttctggtccggggtcttacgcggctggcggcggcagccgccgagagataaggggggcacgtgtgtgcctccgcctctcctctgtctgggccgccgccgccgcttgcccgcctggaaggagagggggtagtccgcggactgcgtctgcgggggcaggaagtctcaaccttctgggctcgggccgcggtgtcgatatccgatggcctttccctctcttcctcgtatgctccttctcctcctcctcctcctcccggcacgcccctgagatctgcctcccctccctctccctcgtcctggtcggaaaagtctgaggaggaaaaggagaatggggaggagtccaaaacggcacgccacctgccgtggggcggtggtgacaggtcccggctggcccggcgcttgctcgcgttcctgccgttacccaggagaatggccgcgagttttttggcggggaggatgcggaatggcgggggcgtttgtcccacgggtgagggggaatcgtcggttagggccggcacgaggtggtgggtctggacccgggccgtgcgagcaaaggcagcgagaaccgaggggcttctgggggtgactgtgatctgttccggatttaggtccatggcgggtgtgtatgttttaataggggtggtctctggcgcggcaggatgatggtcgaggacgtccaccagggccttgcagatgcgcttgcctagatacaggatgtcgtccatgctgaggggagggggggtgtctgctcccccctgcagaagccgcctgggtgcgggggtgaagacaggtggtgggcgggcgtctcgccggactatggcctcggcacgctcggcgtcgatggcgggtggctggaacaggcgggcgaatgtgtaatcccggaaccggtaggcgacgctgcgcctgagggcgcccgtcaggctgtatcccagctccagggcgtgctccacccgctcgttgagctcctcgaggtccggacgcaggggctcgctggtgtgggcccagagggggtgatccgcgatgccccggctctccctgagggccggcaccaggaggcgccttctgagggtggccgtgtcggccgtggccagggcccacctggcggcggcgtcccggcacacatcctggatgccctccacgacgctctttagcgtctggaggtccgtggagtagtggcggggggagtatgaaacgctcttttccttcaccgctaccaccgcctcctcctcctcttccgtcgccagagggatctgcacccccccggtctctgcgtcgtacaggagcgggcgggagcacagcctccaagctgcccccgtcaagcgcgagatgtcctccgagagggtctcacccgagaccagaaagcggcgggtggccaggcccaacgactccgccgtcgtgctgtatctcagggtgaagaggagtgaaaagagggaggtgggccaggcaagcggtggtgcttccgccgcccgctctgaagctgagatagtctcggagatgatgcctgagacctctcggacggcgtccatgatcctaaggactgcgtcgtgggacgacagcccccaggggcccccgccctcttcgtcttctgcaccctcggctcctgcgtccccggccttgccttccccctctaagttgagggggcgcagtccgaccgcctggggggactccccaggcatcggaggggccccgtcatagatctcccagacggtggcgtatatgagctcgagaggacggcgggcccgggtcagctcgggggaagggagggccaggtcgctgccgaaggagaccagccagcgcagggcggccagagagcgggttttgggcagctcgttggagaggacccggcgaagggcgggccagatttggaactcgatgaaggcggccgggaagaaggggctgtggacataggccggatccgcgcgcgccgtttggccggccctcagggaccggcagtatgcctcgacgtctgtccgcggggccgccgccactgccgccgtccactgccttctcccctgctcgccggggagtagggggggcttacaggggagggccggagccggggccggggcctgccacaggcggctgtagcggacccatagcagagacctgaggagttcggatgaaaggtcccccgccacctgctcatactcggccgcgggaggggggacgatgaagatgcgcagaggggttacggcgtcccaagggtccgccgccgcccccacacccacagccgtcgcggcgggggcggcggcgggcgtagaggggccgctggtgcgccgggctcgtctgtccacggcctcggcctccgcccgcaggtaggccgcccgggccacacgggcgaagcggctcgtggggctcgcggtgggcagcagtcggaaaaagtgcagggcaaagcccgatagactctctaggagggcggcggtggcctcgagccacctccaccgcgagcgggacacccggggcacagaggccagcatcatggcgtagtcccccgccacggtctcgttgagcccggccgagagcagaaccgtggccacctgctcgatggcggctggagagaaggatgcccggctccccgccgcctcctgcacacgagcggccagggcctccatctctgccgccatcccggccaggaaggcctcgatgaccgagtctgggacgccgtaagtctggtcccagagcagggcctcgtacacatagtcgtaaaagagggcccctgagggctccaaaagccggagccgggcggcgtcaaaggccaggacgggcacagccgcgacggggggcgtttgtcccccgctggcctccgcgtacacgcccaggatctctaccgcccgccgccgggccaggggcagcgaggccaccacgctggaaagtgactcggggcggtgaaagagaccaccaccgccgctttcttcaccctctcccccgccggccccacccccactgtgctccaccagctccacggccatggccttgatgtccgcggccgtgggctgaccctgccctgcagccgcccaggggtagcggttggtctccgcgtatacggtgaccagccatctccccagcgtcgttttcgccgcgttaaaagcgtagaatgacagcccctcccgcgggaaggcgtcccaccgggccagataagtgtcggccaccagctcttccacgaaggcaaaggtggccgttgggccagagaccgcgagcacctccccgctgccctcttcgatgatgcgccggtacgcggccgccagggcccgggtctctgcgatgagccgagagccgtccagcggatcgtcggtggccggagaggctgtcgtggggggcagtgaggaggccagcacgtccagggccgcctccagatggccgaggccgaagctgcgcctggaaaaggaggccgcccggagtaggtagtaggcgtggtggcggaggaccgccgccgggtaagcgtggccgctcatgagggtgagagtatttaaaaaatcgcgcaccagcaccggctgggccaaatcccccagtccaaagatccccagctccagaggcatcagcgcgcgcaggcgggcagcggggtcgtccccagacagcagcaactgacgcgtcacgcgggcgagccccccgtccacctctgccaggggcggctgggcgtctgcccctccgctaccgccgctgctgtcactctccatagcggacgccatgaaggtccaggggtccgtcgatcgccgccgtctgcaacgccgaatcgcggggctgctgccccctccggcccggcgtctaaatatttcccgggggtccgaattcacgcgggacgttcgtgggctggttgaggaacacgcgcaggcctcctcgctgagtgcggcggccgtctggcgcgcagggctgctggccccgggggaggtggcggtcgccgggggtggcagtggaggggggagcttcagctggtctgggtggcggccgccagtctttggggactttctgatacacgccagctccttcaacaacgccgaggccactggaacgccccttttccaattcaagcagagtgacccgttctcgggcgtcgacgcggtattcactcctctctccctgtttatcctaatgaatcacggccggggtgtagccgcccgggtcgaggcaggtgggggcctgacgcggatggccaacctgctgtacgacagccccgcaaccctggctgacctggtcccggactttgggcggctggtggccgaccgccgcttccacaacttcatcacccctgtgggccccctggtggagaatataaagagcacctatctgaataaaatcaccacggtggtccacgggcctgtggtcagcaaggccatccctcgcagcaccgtcaaggtgacggtgccccaggaggcctttgtggatctggacgcgtggctctccggcggcgccgggggtggcggtggaggatgcttcgtcggggggctgggcctgcagccgtgccccgccgatgcgcgcctctatgtcgctctgacctatgaggaagccgggccgcggtttacgtttttccagtcgtcccgcggccactgtcagatcatgaatatcttaagaatttattactcaccatccatcatgcaccgctatgctgtggtccagcccctacatatagaggagctaaccttcggggcggttgcctgtctggggacatttagtgctactgacggttggaggaggtctgccttcaattaccgtggctctagcctccccgtggtggagattgacagcttttattccaacgtctctgactgggaggtgattctctagacttaacgggaggaaacaggaggaggagggggacaagagcacaaaagtggttcagtggacacccaccacacagcatggcaacgaccagtcatgtcgagcatgagctcctctccaaattgattgatgagttaaaggtcaaggccaactcagaccccgaggctgatgtcctggccgggcgcctgctccaccgccttaaggccgagtcagttacacacacagtagccgaatatctggaggtcttctctgacaaattctacgatgaggaattcttccagatgcaccgggatgagctggagacccgagtctctgctttcgcgcagagcccggcctacgagcgcatcgtctccagcggctacctgtcggccctgcgctactatgacacctatctgtatgtggggcgcagcgggaagcaggagagtgtgcagcacttttacatgcggttagccggcttctgtgcctcaaccacctgcctctacgcgggtctcagggcagccctgcagcgggccaggccggagattgagagtgacatggaggtgtttgattactactttgagcacctaacctcccagacggtgtgctgctccacgccctttatgcgctttgccggggtggaaaactccactctggccagctgcatcctcaccacccccgacctcagctccgagtgggacgtgacccaggccctctataggcacctggggcgctacctctttcagcgagccggggtgggtgtaggggtgacgggggctggccaggatgggaaacacatcagcctcctgatgaggatgatcaacagccacgtggagtaccacaactacggctgcaagaggccggtcagtgtggcggcctacatggagccctggcacagccagattttcaagtttttggaaacgaagctgccggagaaccacgagaggtgcccgggcatctttacggggctctttgtccccgagctcttcttcaagctttttagggacacgccctggtcggactggtacctgtttgaccccaaggacgccggggacctggagaggctctacggggaggagtttgagcgcgagtactatcggctggtgacagcgggcaagttttgtgggcgggtctccatcaagtccctgatgttctctatcgtcaactgcgccgtcaaggccggcagccccttcatccttttgaaggaggcctgcaacgcccacttttggcgcgacctgcagggcgaggccatgaacgccgccaacctgtgcgccgaggtgctgcagccctcgaggaagtctgtggccacctgcaatctggccaacatctgcctcccgcgctgcctggtgaatgcgcctctggcggtgcgggcacagcgggccgacacgcagggggatgaactcctgctggccctccctcgactctcagtcaccctacctggagagggggcagtcggtgatggattctcgctagcccgcctcagagatgccacccagtgtgccacctttgtggtggcctgctccattcttcagggatcccccacttatgattccagggatatggcctccatgggcctcggggtgcagggcctggccgatgtctttgcggacctgggctggcagtacactgaccctccctctcgctcgttaaacaaggaaatattcgaacatatgtactttacggccctctgcaccagtagtctgattggacttcacaccaggaagatttttccgggtttcaaacagagcaagtatgctggggggtggtttcactggcacgattgggcaggaacagacctttctattcccagggaaatttggtctcgcctctctgaacgcattgtgagggatgggcttttcaattcacagtttatcgccctgatgcccacctcaggctgtgcccaggtgacgggctgttcggacgccttctaccccttctatgccaatgcgtccaccaaggtcaccaacaaggaggaggcccttaggccaaaccggtctttttggcgtcatgtgcgtctggatgacagggaagctttgaatcttgtcgggggccgtgtctcctgcctcccggaggctctgcggcagcgctacctgcgtttccaaacggcctttgattacaaccaggaggacctgattcagatgtcccgggacagggccccctttgtggaccagagccaatctcacagcctgtttttgcgtgaggaagatgccgcgcgggccagcacgctagccaacctactggtgcgcagctacgagctgggcctgaagactatcatgtactattgtcgcattgagaaggccgccgatctgggggtgatggagtgtaaggccagcgcggctctgtcggtgccacgggaggaacagaatgagcggagtcccgctgagcagatgccgcctcgtcccatggaaccggcgcaggttgcggggccggttgacatcatgagcaagggcccaggggagggaccaggtgggtggtgtgtgcccgggggattggaagtgtgctataagtaccgtcagctcttctcagaggatgatctgttggagactgacggttttactgaacgagcctgtgaatcttgccaataaacgtttattgccatgtccaagttgttgtacgtgcgtgatcatgagggctttgcctgcctaacggtcgaaacccaccgcaaccgctggttcgcggctcacattgtcctcaccaaggactgcgggtgtctcaagctactcaatgagagggacttggagttttacaagttcctctttacgttcctggccatggccgagaagcttgtgaactttaacattgatgaactggtcaccagcttcgagagccacgacattgatcactactacaccgagcagaaggccatggagaacgtccacggggagacttatgctaacattttaaacatgctctttgatggggacagggcggcgatgaacgcctacgcagaggccatcatggccgacgaggccctgcaagccaagatttcctggctccgtgacaaggtggcggccgccgtcaccctgccggagaagattcttgtgttcctgctgattgaaggcatcttcttcattagctccttctacagcatagccctgctgcgggtccggggcctaatgcctggcatctgcctggccaataactacataagtagggatgagctgctccacacccgcgctgcctccctgttatacaatagcatgacagccaaggctgaccgaccaagggccacctggatccaggagctgtttcgcactgcggtggaggtagagactgccttcatcgaggctcgtggagagggggttaccttggtggatgtgcgagccataaagcagtttctggaggccacggccgatcgcatcctgggtgacattggtcaggctcccttgtatggcacaccaccccccaaggactgcccgctcacctacatgactagcatcaagcaaactaatttctttgagcaagagagttccgattacaccatgctggtggtagatgacctttgagtcagggtggctacttgctcaggtttctgggcataaattctcctgcctgcctctgctctggtacgttggcttctgctgctgcttgtgatcatggaaaccactcagactctccgctttaagaccaaggccctagccgtcctgtccaagtgctatgaccatgcccagactcatctcaagggaggagtgctgcaggtaaaccttctgtctgtaaactatggaggcccccggctggccgccgtggccaacgcaggcacggccgggctaatcagcttcgaggtctcccctgacgctgtggccgagtggcagaatcaccagagcccagaggaggccccggccgccgtgtcatttagaaaccttgcctacgggcgcacctgtgtcctgggcaaggagctgtttggctcggctgtggagcaggcttccctgcaattttacaagcggccacaagggggttcccggcctgaatttgttaagctcactatggaatatgatgataaggtgtccaagagccaccacacctgcgccctgatgccctatatgcccccggccagcgacaggctgaggaacgagcagatgattgggcaggtgctgttgatgcccaagacggcttcctcgttgcagaagtgggcacgccagcaaggctcaggcggcgttaaggtgacactcaatccggatctctacgtcaccacgtatacttctggggaggcctgcctcaccctagactacaagcctctgagtgtggggccatacgaggccttcactggccctgtggccaaggctcaggacgtgggggccgttgaggcccacgttgtctgctcggtagcagcggactcgctggcggcggcgcttagcctctgccgcattccggccgttagcgtgccaatcttgaggttttacaggtctggcatcatagctgtggtggccggcctgctgacgtcagcgggggacctgccgttggatcttagtgttattttatttaaccacgcctccgaagaggcggccgccagtacggcctctgagccagaagataaaagtccccgggtgcaaccactgggcacaggactccaacaacgccccagacatacggtcagtccatctccttcacctccgccacctcctaggacccctacttgggagagtccggcaaggccagagacaccctcgcctgccattcccagccactccagcaacaccgcactggagaggcctctggctgttcagctcgcgaggaaaaggacatcgtcggaggccaggcagaagcagaagcaccccaagaaagtgaagcaggcctttaaccccctcatttaacaccatgttctcgtgcaagcagcacctgtccctgggggcctgtgtcttctgtctcggcctcctggccagcacccccttcatttggtgctttgtctttgccaacctgctctctctggagatcttctcaccgtggcagacacacgtgtacaggcttggattcccgacggcatgcctaatggccgtcctctggacgctggtacccgccaagcacgcggtgagggccgtcactccagccatcatgctgaatattgccagcgccttgatcttcttctccctcagagtctactcgaccagcacgtgggtttctgccccctgtctctttctggccaacctgcctctcttatgcctgtggccccggctggccatcgagattgtttacatctgcccggctatacaccaaaggttctttgaacttgggttgctcttggcctgcaccatctttgccctgtccgtggtctccagggccctggaggtgtcggctgtcttcatgtctccatttttcatctttctggctttgggctctggaagcctggccggtgctcggcgtaaccagatttacacctcgggtctcgagcggagacgcagcattttctgcgcccggggagatcattcggtggcatccctgaaggagaccctccataaatgcccgtgggatctgctggccatctctgccttgaccgttcttgtcgtctgtgtgatgattgtgttgcatgtgcacgcagaggtgttctttggactctctagatacctgcccctctttctctgtggggcgatggcctccggggggctgtacctgggccattccagcatcattgcatgtgtcatggccaccctctgcaccctgacatctgttgtggtatatttcctccatgaaacccttggacccctgggcaagaccgtgctgtttatctcaatctttgtctattactttagcggggtagcggccctgagcgcagctatgcgctacaagcttaagaagtttgtgaacggacccctggtccatctccgtgtggtatacatgtgctgttttgtctttactttttgtgaatatctgttggtgacattcattaaatcctaacgaccggagtcctgtctctttgtgttcttgggggacttgagttagctgtctttcctcttattacattgggctaacgggaggaaatgaacccaggggtggcagtggatggggtcatttatgggcaaaactcacaggacatgtttggggagttagcattggcgtcgggaaacacagctctggcagttataaccgcaccagctaacaggacatgtttgggggagttggcattggcgtcaggagacacggctctgtcagttatcaccgtaccatgagtgccatgtgtgtccagtgcctaatcaccgttcctcattttgtgtgcctcctcaaatgttccagaagtcggccacaggggaggtggctgaattagggccttttccctcattcccccatgagacccacgtggcaggcctaggggctacattcgcctcccacgtttcccttcgcgtgaggcatccgatatgactgaattttcgcagtctcttttccctcttcccttgttattcccatagaattacagtgaggttacacaggtggagattcagtttaaccatttattgatttaatccaggaacaaaaaacagtcctagtgacccagtggccggagagagaatggccctgacaagtcggctgcatgatgcacttcggcagtcacgtgtgtgagtctccacggcctctgtcaaaagggagcttagcgtgccagggttgtaattcttgatgtagtggcccaggaattcaacttcatcgtgtctccgtctgcagttggcgttaatgtaggctggggctactgccgcatatgctgccaagagacagaggggctgcttcacatatgagctgctcagggtctccaccaccttgttttgacgggccgtggcacaggtgatgtagaagagttgcttcacaaagttgtagtctcgcgtgttaggaaggaagcagggtgccagctctttgagcttggtcaggatcaccttgctaagactcatggcgcaggccaggaggatgtcttccgcgggagctaggggcaggtcgccgtggtaggtgatctcctggagccaaaagatggtctcttctagcatggccaccagggtgcagagccccgcgttctggatcgcctgcatgcgtgcatccagccatgtgtccttgttggttgacttggtgaaaaactcacgtagtgtcttgtagctcctgcgcagctcgtgtctgggttgcactttctgccaggctccaatctctggatgggcggccaccgccagcatcgactgtaggaacgggtcttggatgggctctagggtcagagaggccagggggctgggcaaggtgacaaatgtaatcttggagacaggcttaaccagactcatgtcaaaccacggtttgttgggcaggggcctctggctgcgttcttgcctcgcctgcttccttgtgctcctgccggcccctcgagattctgaccggggacctctggttgctctgttgcttcggggagctcttggagacctcggtgctctaggcaccctgggggcccttggggctctgggcgctcttgctcccgggggcaggtgtcggcgcttgccataactttcatcggtgcagccatggacctctccgcgtcgccttttgtggcctctggtgtaagaggagttgccagtctcctccttctcgtcctcgtccctgcacaggggtgagcgatgcagcgtgaccgtcttgtcctgtaggtcccacttctttctgggaatcacaaacgatgccgaggtaggggttatgaccacgctggagggctgtgcaggtatggcgtgggccggagttggatcttcatcctcctcctctgaggatgaaatctctccatctgtggagtgttcttcgctgccgtccatagggtccatatcgcagtctgtgttggtgtctgagaccgcttcgagttccagaatgtggctctctgcagaggggagacaaaaggtggagactgccttgagcacctctatctcaggcaccggatgcccccggctccacggccccggcccctggccggtgtagcttcttacctgcgggatcctcgttggaggaaatgctgctagttcgggagagtctctgagaaggaaccatcttgtctgtctctacgacgggctagctgggatgtagtgctgtcttgactggcctcagccctatttatgattctggaggcgggcacgctgatggagaaatgggcggtcggttgattggccccacagcgaccggcgaagcactgactcatgaaggtgaccgtgatggcctgtgatgtgtagtagagtaccagaaacaccctcacattcttggagctggccctgtgggtatgcctcaggcacgcaaagttcctgccccgggcatggcacacctgaactaagtttggcccggtttgctcaaacgtgacatggagaaactgggggaatttgtcttctggcacagctgttgccagggtgctcatgagcgagggccagatgcaggagctgacccaggcgacgagatccaggcccagatgtccctctatcatggcgcagacattctccacggtggggggcagggtctcgcgggtcctctggattagatagtcacgcccatcatccgcgatgtggtagcagaaggttttgggggccggccagcccacgtgcagtgagtgatgtaagaggttttgaatgttgagggcattcttaacatagctgtgcttgtcttcctcttccggatgacagacaaagaggcgcagctgccggctaagaccaccgcccctgtccaccttgtaggtatgcggcagccggatgcaccgcccggcgtgatacacgccgctgtcaaaaagcggggccccaatctctttgatcttgtgacgcatgcggcgcaggcaggccgttaggcccatgagcttctgcagcacagacacaaacccttgtactgcgcttgttcccacaatagcatggcctctaggtaggggtgtgatgacgcgaaagcccagttttcccgtgcatatgcaaaaggggagcacatcttccatattatccgggtcggcgggtggacaagctgatttgaaaaaatagactgggtgggccctggacactggacccaggcggcgcatgaggcgcagtacctcacgccgcacggtccggcacaggtcatagatttcctccagcgaccagggggggcccttgatctttagatccaggtccaggaccaggttgcagaccggaagccggggattaaagtattcatgccgggagacaaagagctgctcgctcaggctgttctgtgaatagtacactggggtgtaggagagggccctggtgagacacgtgtctgggaggcggcagttggtcggggtggagacgacctccgccaggtgggacgagaaggggtcagcggctgtcattacaaagtagtgcctgtctgcaaaatggcagaggaagaccggtagccgctgcacccttcgaaggacggtgggtgggaggaattgttccttgggattccactggccccggcaggtggcctggccggccaagcatagaaacccttgaagcgtgggggggtatgtgggaccctcatccgcgtgccagcgcgcgagctccaccagctcccgggccacgtccacactgagcccggcccaggcccgcatgagtccgtcatcggggtcggggtcccacgtgtatggggccgggggctccatgcggattttcagctgctggacacgcacatgctcagccaggtaagtctcccgggtgaagtaggtgcgcatgtgctccgcaaagcccctgtccaggagcgaggggagcacgacgccccccgaaggcagacacccaatttctcccacgctcgttaactgagagtatcgcttaaaggttccctcgttgaagcactgtgcgtgggccaaatagacgtagcgcacgagatcggccgaggccaggggaaggcgccccctgtaggcgtctatcgtccttgccacagtgcggatctctcgcgagtcccgccgcagcttctcgtgtgcaaagtgggcaaaagcctctgtctgctccgcccatgccgaggagccaaagacctcccccagctcggccagggacgtgacggcggccaggctctgaccagactcggaagtaaatagctccgtgaggtgcgccagggtctcaatcgtacaaggaatgccccaaaaatagtaagcagccgtgactagcacgaactgggcctcgtgggagccaaaggtgctaatgaaccacctggccgagatgttaacgcggtagatgcggcgcagacagcccacgatcttgggacgcagccacgccacgcggcctctggcatccccctgtggctgcttcttggcgctcagtgtgagcagttccacgaggggcgtgagcgagcgcagggcccccgcgcgatctaggtaggtggatagacggtccgcggtgagcggcgtgaggccgcgcaggaaggggaaggcctcctccgccggcaggcgcagcgtcagaaccaggccgcagcggctctgtgaggtcagccgcttcttgggcaggtgaagctgcagttccacgagagaacccgccacgtggtggaggggcgaggcgttgtggcacaaacaaaacaggcggaagccctcgtcaggccgcgagaggatggcatccaggatggcctccgcaatgtcagtgtttgaggccacaagggccttgatgacgacgggggtggacattatttaagaccgggaggccccaacggcgggctaaacagaacgatggccttctatctcccagactggtcgtgctgcgggctctggctctttggccggcccaggaatagatacagccagctccctgaggagccggagacctttgagtgcccggaccgctggcgagccgagatagatctgggcctgccccctggtgtgcaggtgggagatttgctaagaaatgagcagacgatgggctcactgagacaggtttatttgctcgccgttcaagccaatagcatcacggatcacctgaagcgctttgacgccgtccgcgtccctgagagctgtcgtggggtggtggaggcccaggtggccaagcttgaggccgtgcgctcagtcatctggaataccatgatctctctggctgtaagcggcatcgagatggacgagaatgggctcaaggccctgctggacaaacaggctggcgacagcctggccctgatggagatggagaaggtggccacggcgctcaagatggacgagaccggtgcctgggcgcaagagatctcggccgttgtctcatcggtgaccgccccctcagcctcggcccctttcatcaactccgcctttgagcccgaggtgcccacccccgtccttgcaccgcctcccgtggtgcggcagccggagcactctgggcccacggagctcgcgttaacgtagcaaccagactccacaccaaataaacattttattgataaaacaagggatatgaaggtgtcattgacccgaggatccaaaccccctcccctgtctcccctcgagcgcctcgctcagcccactatcacccatggccaggcccggcacctcctcgaaggcgcagctggcccacctaaagagagatctggggccaaggacccccgcgtcactgtgggggctgtagaaggaggtgaggtggtgcttgtgaaggtaaacaagctgacagaagcgccggtacttgttaaggaacacggtctggtcactaaagttggtcaggctgacgtccaccccaccccggcgccacctgcagggcttcactagaataccctgcatggccaggcccgacctgccaaagattgtcggcctgtggtgagggatagaaggggggggcacggtgagtgtcactgagacggtctgatgggggaagagggccaggtcctttggcaaagagacgtccaggcccacgtccccggggtactgggggtggttgatgggacccttgtcctcctccatctggggggtggcatatctgaaggcagccaggtggattttgagctccgatggacgcagcgtggagttgtagcgccgctgattctggaggattagccggagttcccccgtgtagccgggatcgatgatgccaacatgagacgtgaccggacgggaggtgctgccccacagcatgagcccatgaccctcgggtgggcgggcatagaggcctaggtccacagttgtggtcttcatcgggcgcagcaggatggtggtcttgttgaccaaggtgagccgccctacactagcctgctggagcaacagcttgtcattctggaaggcgtagcgtatgtgtggacaggcctccatggtgatgatctaacagacagggacggcggcgctatatataagagcccaagacccggctctctttactgcgaaatggggaaggtcctaagaaagccgtttgcaaaggctgtgccactgctcttcctcgccgccacctggcttctgaccggggtgctgccggccggcgcttccagtcccacaaacgcggcggcggcttccctgactgaagcccaggaccagttctactcctacacatgtaatgcggacacattctcgccttctttgaccagctttgcctccatctgggcacttctgacgcttgtcttagtcattatagcctcagccatctacctgatgtacgtctgctttaacaagtttgtgaacacgctgctgacggattagatggggatatttaaaaggggcagcaatctcggctgtctgtacttcttctctgctcgttaaaccaatagcatgtcagctccacgcaaagtcagattgccttctgttaaggctgttgacatgagcatggaagacatggccgcccgcctggctcgcctggagtctgagaataaggctctgaagcaacaggtcctcagggggggtgcctgtgcctcgtctacctctgttccttctgctccagtgcctccgcctgagccgcttacagctcgacagcgagaggtaatgattacgcaggccacgggccgtttggcgtctcaggctatgaagaagattgaagacaaggtgcggaaatcagttgacggtgtaactacccgcaatgaaatggaaaatatattgcaaaatctgaccctccgcattcaagtatctatgttgggtgcaaaaggccaacccagccctggtgagggaacacgaccacgagaatcaaacgaccctaacgccacccgacgtgcccgctcccgctcccggggacgtgaagcaaagaaagtgcaaatttctgattaataaatctttattgactttatacataggtctcggcgtcatcatatggtggggtggtgtaggtatgggatgtcgacaagttacgcctgaaggcgcagtccgccatgaccagcagcagcagaagggtcagcacagccagagatgcccactgcagtactagcatggagaggtttgagaatctgggctgggacgttggcgggacaggcacggtggcttgggctgtggtaaccggtgggctcgtaaaagtccagcggggccgcagtttgctagaagtgctgggaggtagataggtggtcgcattgtatctcggtcttggcgtagttgaatcatcgccgtaatctgtggtgggctctgtacttgtccgggctccatgtcctgtggtgtgctttccaccggtggtagaattggcctttccacctgttgaggtgaccgtgggaaccgccgtcttttggccactgggggcctggggcgacgttgcatttttggggggcgtgcctttggtgacattaacctcccccggttttgtggatgtggaactgtttccagggcctgacgcttggctggtggtgcctgggcggggcgctggcgaactggtggacacatgatgtgtgctgatagaggctggtgtcacctgtgttatattttcaccacctgttgggtgagcggaggttagtaaaggcatatgtgacgttgtctctgggattgaactgggtctcagtgacatggaagaggttgaacttgaagttctgttatgttggcctgtggtaacatcactggttgcattttttggtgggctggtaactactggggtgggacttgttcctcctaaggtgtggttggtggcatttgcctgtggacttgtttctcccacagtagggctggtggcatttggggttggggtagtcactgctggggtggggctggtggcatttggggttggggtagtcactgctgaggtgggacttgtttttcccaaggtggggctggtggcatttggggttggggtagtcattgctggggtggggctggtgccatttggggttggggtagtcactgctgatgtggggctggtcatgtcgggggccttactttctgtgccgttgtcccgtggagatggacttggtgtcaccggtgatgcgcctgacgttgtgccggctggtgttgggctggtgacatccgctgtggatacagtggggcctgtgcttgcaggtgcggtgaggttggtaggcacgtgagtagagctgggtagacctgtcgttgtattgggatcagcaaatccagttgtattcaaggtaggggaggtggtggtgctctcgggtgccttggagaatataaccttgtgggttgttgtggtggcattggtagccgttcgtgtgataatgagtgttttgggggccgtgccaagacccgagacagtaatgtcaaatgtccgattgctcgcaaatgcaccagaaatattttcacaacccgaaggtgtccccgaggtgagagtccatttgcacttaaagtcagtttcagtgttgtttggccaggcccaaaaggcagtcactgtaacatttggcgagtttgcgtcctcagaagtgaccattggcactgaataggtagcattgtcacccacatatgtgatgtctgtggtgtttgtcggcatgtcctgtgaagctggaatctcatcagagaacacaatgttggactgaatgcagtaatctcccccgctcgccttcggtccattcccagagtaaaacacgtacaggatactgttattgccaagaaatcgtgacactggacgtggtgtcagacgcaggctgtatgcataccctgtaccaggtattggggtggccacgggactcgttgatgtgagaattccgccgctgggaacatggctctcgtatccactgcaggtgatgttaaatttgttgtctccgggcagaacttgtgaaatttcgccatcctccataatacactcaatatctatctcattaccgagcatttgtgtttttacgctgaaattcgagtcttgagctgacgttggcaaacttaagggtaacgtgacatccagcccctgtgccctcactactgccgttatattggtagaattacagttatcccactttatgtatggcactgtttctggtatcaggtacacggggttttgcatttctgcatggtggcaccacatggttccaaacacatcttgaaagtagacatctacagattccaggcttacttgttgctcctctccggtggtgacgttaattggaagcttcttagaccgcatagttagagccaattctcctgcaccaaggagctccagtagaaagagattggtggcattttctgagccaccaaatgcacctcgaggttggtagacagccttcgtatggggtgtcagctggccaaagtcaagatcaagttgatgctttttgcccccgacatcgaaattgatagttacattgacatctgccgtacaaacattgcatgtggggtaaaatgggaattccggaatctcaacattgaaaaaaccaggatcttcacccgtgagatggatcaggctctggatggtgtactgacacacaagcaaggctgcctccattgtctcggcaccgatttctaggcagcatcctctttaataggtacaaggggggtgcggtgttggtgagtcacacttttgttgcagacaaaatggacaaggacaggccgggtcccccggccctggatgacaacatggaagaagaagtcccatctacctcggttgtgcaggaacaggtatcggcgggagattgggaaaacgtcctcatagagttatcagatagcagctcagaaaaggaagcagaagatgcccacctggagccagcccagaagggtacgaagagaaagcgggtcgatcatgatgccggtgggtcagctccagcacgacccatgctcccaccccagccggatctccctgggcgagaagccattctccgcaggtttccactagatctaagaacacttcttcaagcgattggagccgcggctacggtgagcatccctatggcctaggtgtgtgatgtgtgtttttacccatcacacaacaagaaggtaagtaatttgttgccgttggtttcagcgcatcgacacacgagccatagaccagtttttcggatcccagatttcaaataccgagatgtacataatgtatgccatggccattcgacaggccattagagatcgtcggagaaatccagcttctcgtagagatcaggccaaatggagactgcaaaccctggccgccggatggcctatgggttaccaggcatacagcagctggatgtacagctacaccgatcaccagacgactcccacattcgtacatctccaggcaacacttgggtgcacaggtggccgtaggtgtcacgtgaccttttccgccggcacctttaagccgccgcgatgtacccccggggatcgccagtggttgtatgttcagagctccgtgggtaacattgtacagagctgtaatccccgctacagtattttctttgactatatggctatacacaggagcctcacgaaaatctgggaggaaattttaacacctgaccagcgtgtttcatttatggaattcctaggatttttgcagagaacggatttgtcctatatcaagaactttgtcagcgatgccctgggcaccactagtatccaaacaccgtggatcgatgacaatcctagcacggagacggcacaggcttggaatgccggctttctccggggtcgtgcgtatgggctagacttgcttagaactgaaggggaacatgtcgaaggtgctaccggtgaaacgcgggaagaaagtgaggacgcggagagcgatggagatgatgaagatcttccttgtatagtgtccagaggtggacctaaggtcaaacgaccccctatatttataagacgtctgcacaggttgttgctgatgagagcgggcaaacgaacggaacagggcaaggaggtactggaaaaggcccgtgggagcacttatggcacacctaggccacctgttccgaaaccaagaccagaggtcccacaaagcgacgagacagctaccagtcacgggtcggcgcaagtcccagaacccccaaccatccacctagcagctcagggaatggcatacacattacatgaacaacacggcatggccccgtgtccggtagcccaggccccacctacgcccttgccccctgtatctccaggggaccaactcccaggtgtttctagcgacgggcgagtggcgtgtgcaccagtacccgccccggctgggcctattgtccggccctgggagccatccctgacacaggctgcggggcaggcctttgcacccgttagaccacaacacatgccagtagaacccgtccctgtcccgacagtggcacttgagcgaccagtttaccccaagccagttcgtccggcacctcctaagtttgctatgcagggccccggggaaacttctggcattagacgcgcgcgggagcgttggaggcccgcaccttggacgccaaatccaccccgttctcccagtcagatgtccgtgcgtgaccgtctggctcgtttgcgtgctgaggcacaggtcaaacaggctagtgttgaggtgcagcccacccagttgacccaagtatcccctcagcaaccaatggaggggccgttggtaccagagcagcagatgttccctggtgccccctttagccaggttgctgatgtggtccgggcacctggggtaccggcgatgcagccacagtactttgacctccccttaattcaacccattagccagggggcacccgtggccccgttgagggctagtatgggcccggtacctccggtaccggcaacacagccacagtattttgacatccccttaactgaacccattaaccagggggcatccgcggcccattttctccctcagcaaccgatggaggggccgttggtacccgagcggtggatgttcccaggtgccgccctgagccagagtgttaggccaggggtagcgcagtcacaatattttgacctccccttaactcaacccattaaccatggggcacccgcagcccatttcctccatcagccgccaatggaggggccgtgggtacccgagcagtggatgttccaaggtgccccccctagccaaggcactgacgtggtccaacatcagctggatgctttggggtatgcactccatggtcttaaccatcccggggttcccgtgtctcctgccgttaaccaatatcatctcagccaggctgcctttgggttacctattgatgaggatgagagtggcgaggggtccgatacctccgagccgtgtgaagctcttgatttgtcaatccatggcaggccctgccctcaggcccccgagtggcctgttcaagaggagggtggccaggatgccaccgaggttcttgatttgtcaatccatggcaggccccgccctcggacccccgagtggcctgttcaaggggaaggtggccaaaatgtcacaggccctgaaactagaagggtggtggtgtcagctgttgttcacatgtgtcaggatgacgagtttccggatctacaagatcctccagatgaggcctaagcaaaggtgtagaagtgtgtccccctccattccacccactgataatacgcccgacaataaagttgatgatattgaattccacacctgcttgtgtttgtgattttatttcatattccatgagagagacctcgcatatttgcagaagggtcactgaaacatcttatcttaaaacagttacacctgaataatgaagaaagcgtggctcagcagagcacagcaagccgatgccgggggggcatctggctccgaggacccaccagattatggagatcaaggtaatgtgacacaggtggaatctgagcctatttcacctgagattggcccctttgaactctctgcggccagtgaggatgatcctcaatctgggccagtggaagagaatttagatgccgctgcaagagaggaagaggaacctcatgagcaggagcacaatggtggtgacgatcccttggatgtccatactcgccagcctagatttgtggatgtgaacccaacgcaggctccagtgatccaactagtccacgctgtctatgattccatgttggtaagaggcacctagaacatttccagatgtttcgcttggattttttggccagtcttaattaattgtcattggtttcagcaatcggacctccggcccctaggcagtttattccttgagcaaaacctgaacatcgaagaatttatatggatgtgcatgaccgtgcgtcacagatgtcaggccatcagaaaaaaaccattaccaattgttaagcagaggcgttggaagctcctgtcatcttgcagatcctggcgtatgggttaccgcacgcataacctcaaagtaaacagttttgagtcagggggggacaatgtccacccggtccttgtgactgctacgctaggatgtgatgagggcacgcggcatgcaacaacgtacagtgctggcattgtacagataccacgaatatcagaccaaaaccaaaagatcgaaacagccttcctgatggcacgtcgtgctaggtcactttcggcagaaagatatactttgttctttgatttagtatcctccggaaacaccctgtatgctatatggattgggctgggcacgaaaaaccgagtttcatttattgagtttgtaggatggttatgcaagaaggaccacactcatatacgcgaatggttccgccagtgcaccgggagacccaaagcagccaagccatggttaagagcgcatcctgtcgccattccttatgatgatccgttaacaaacgaggagattgatctggcctatgcccgtgggcaggccatgaatattgaggctcctagactgccagatgatcctataattgttgaggatgacgacgaaagtgaggaaattgaagctgaaagcgacgaggaagaagacaagagtggaatggaatctcttaaaaatataccgcaaacactgccgtacaatccaacagtatacggcaggcccgcggtgtttaaccgaaagtcagatgcaaaatcaaccaaaaaatgcagggccatagtaactgactttagtgtaatcaatgccattgaagaggaacacagaaagaagaaggcagccagaacagagcagccaagagccacgcctgaatcccaggcccccacagtggtcctccagcgaccacccacgcagcaagagcctggccccgccggcccactgagtgtccaggctcggctggagccatggcaacctttgcctgggccccaagtgacaacagttctacttcacgaagaatccatgcagggtgtccaagtacatggttcgatgctagaccttcttgaaaaagacgatgaagtcatggagcagagggttatggcaaccctactgccaccagtaccacaacagccccgggctggcagaagaggcccttgtgtcttcaccggtgacctaggcatagagagtgatgagcccgcttcgacagagccggttcatgatcagctactgcctgccccaggacctgaccctcttgaaatccaaccactaacgtcccccaacacgtctcaacttagcagttcggcaccaagctgcgcacaaactccatggccggtggttcagccaagtcagactccagatgacccaacgaaacagtcccggccaccggaaacagctgccccacgccagtggccaatgccactgcgacctatccctatgcgccccttgcggatgcagccaatcccatttaatcatccagtgggacccactccccatcagacacctcaagtggaaataacaccatataagcccacttgggctcagatagggcacattccatatcagcctacaccaacgggtcctgctaccatgctgttgcgccagtgggcacccgccaccatgaagataccaccgagagcgcccactcccatgtcaccacctgaggtgccgcccgttccccggcagaggcctcggggggcgcccactcccacgccacctcctcaggtgctgcccactcccatgcagctggcactaagggctcctgctggtcagcaggggccgacaaagcaaattttgcgccaattgttaacggggggcgtcaagaaagggagaccatcacttaagttacaggccgcccttgagcgtcaagccgctgcgggctggcagccttcaccagggtccggcaccagtgacaagattgtgcgggcgcctattttctacccacccgttttgcagcccatacaggttatggggcaagggggttccccaacggccatggccgcctcagcggtgacacaggcacccacggaatataccagggaaaggaggggagtggggcctatgcctcccaccgatattccgccgtctaaacgagcgaagatcgaggcctatacagagcccgagatgccgcacggggggggctcgcactctcccgtcgttatcttggagaatgtcagccgggggcaacagcagactctggagtgcggaggaactgctaaacaggaaagggacatgttggggctgggggacattgcagtttcttccccttcctcttctgaaacatcgaacgatgagtgatttcgcccatgtaacaagaactgggatgaaccctggggcaacagactgcggggaggaggggggcagtgataagtcatgacaattttagatgaggtagaaattttgcatattttcagacccaccatggaatcatttgaaggacagggggactctatacagtcacccgacaatgagcggggagatgatgtacagactaccggtgagcatgatcaggaccctgggccggggcctccatccagtggggcttctgagggattggtaccagaagagtcagactcaagagatcagcaaccttgggggcaaagcaggggtgatgaaaacagaggctggatgcagcgcatcaggcgaaggcggagaagacgggctgccttgtccggccatcttttagacacggaagacaatgtgccgccatggttgcctccacacgacatcacaccatatatcgcaaggaatatcagggatgccgcctgccgggctgtcaaggtgagtatgcctctaactgggttcatgggggccatctaaggcccacgtgtgacccatgtttccattaattttagcaatcgcacctgcaagcgctatcaaacctgatactcgatagtgggttagacacacaacacgtcttgtgcttcgtgatggcagccaggcagcgtcttcaggacattcgacgtggacccttggttgcggagggcggtgtgggttggcgacattggcttctgacatctcccagccaatcctggcccatgggatatcgtacagcaacactacgcacattaactcccgtgcctaacagggttggggctgacagcatcatgttaactgctacatttggatgccacaatgcggcacgaactctaaacaccttctctgccaccgtgtggacaccaccccatgctggaccaagagagcaagaaagatacgctcgggaagccgaggtacgcttccttcgtggtaaatggcagaggcggtaccgaagaatctatgatttgatagaactgtgtggctctctgcaccacatctggcaaaacttgctccagaccgaggagaaccttttagatttcgtgcgtttcatgggtgtcatgtccagctgcaataatccagctgtgaattactggtttcacaagacaatcggaaactttaagccatattacccgtggaatgcaccacctaatgaaaatccatatcacgcgcggagaggcataaaagaccatgtaatccagaacgcatttcgaaaggcacaactacagggtttatcaatgttagcaacgggaggtgaacccagaggtgatgctactagtgagacgagcagcgatgaggacaccggtagacagggttcggacgtggagctagagtcctcggacgatgagctgccatatatcgatcccaatatggagccggttcagcagaggcccgtcatgtttgtgagccgtgtgcctgcaaaaaaaccgaggaaactgccttggcccacgcccaagacgcacccagtgaagcgcacaaatgttaagacctctgatagatctgataaggcagaagcacaaagcacccctgaaaggccgggcccttccgaacaatcatcagtgaccgtggagcccgcccaccctaccccggtggagatgccaatggtgattctccatcaaccacctccagtgcccaaaccggttccagtcaagcctacgccaccgccttcccgtaggagaaggggagcgtgtgttgtgtacgacgatgatgtcatagaggtgattgatgttgaaaccaccgaagattcatcgtcagtgtcacagccaaataagccacatcggaaacatcaagacggctttcaacgttcaggccgacgtcaaaaacgagccgcgcctcccaccgtgagtccttcggatactgggcctcctgccgcggggcctcctgccgcggggcctcctgccgcggggcctcctgccgcggggcctcctgccgcggggcctcctgccgcggggcctcctgccgcggggcctcctgccgcggggcctcgtataatggcgcctcccgtcgtacgtatgtttatgagggagcgacagctcccccagtccaccggccgtaaacctcagtgcttctgggaaatgcgggctggtggtgaaattacacaaatgcaacaagaaccaagttcacacctgcagtccgccactcagcctacaacgcctcgcccatcatgggccccatcagtctgtgccctctcggtgatggatgctggtaaggcccagcccatacaaagttcacacttgagttccatgtcgcccacacagccgatatcgcacgaagaacaaccccggtatgaggatcctgacgctcctctggatttaagtttacatccagacgttgctgctcaaccagctccccaggctccataccagggataccaggagccgccggccccccaggctccataccagggataccaggagccgccggccccccgggctccataccagggataccaggagccgccggcccccgggctccaatcatcttcatatccaggatatgcgggtccctggaccccaagatctcaacatccatgttataggcacccctgggcaccatggtctcaagatcccgtgcatgggcacacccagggtccatgggatccaagggcaccacatctcccacctcagtgggatggatctgcaggacatggccaggatcaggtctcccagttcccacatctgcaatcggagacaggcccaccacgtcttcaactttcattggtgccactggtctcatcctctgcaccatcatggtcatctccccagccccgagcccccatacgccccattccaacaagattcccacctccccctatgccgttacaagatagcatggccgtggggtgcgactcatcaggtacagcatgcccaagcatgccctttgccagtgattacagtcaaggtgcatttaccccactggacattaatgccaccacgccaaaaaggcctcgagtagaagaaagttctcacggacccgcccggtgttcccaagctactgctgaagcacaggagattctcagtgacaattctgagatctccgtgttcccaaaggacgcgaagcagactgactacgatgcatccactgaaagtgagctagattaaggggatccaaggtgacccctgttagctatttgatctttgactgacacataaacatggtttaaggaatgaacactcatggtgtgagactggaactgtactaaatttgctgacatatgtacaatgagagccaaaaatttgataaaccttaaaagtccccccatctaatgatgtccagttcccttctcccaccctgtacaccccgacccaaagggactcaatggcattcagatttctagttaccacaggtagaatatcgggcgttggcccataaaaataagtgcatggatatagctctgcacaggcttggaaacacccattccaggtgtgcttctttttggtgaaataaaaacagcatcctttatatgaaaatgtgtattctctggtgttgcagtatgtacagttagctttggtatagttttggggtacctgaaatgtgtgcagggtgggtgtccaatgtggcagttttacctctttgtccccatactcctgctcggctgtcttgttaaagttaaccggcggtggaggatccaccggccagacctctacatttggtttgggaacccaggtgatggccgcggctgccacccgccctcctcctcttaccctgggtggcaaaaagtatgccaggagtagaacaataacaagtgcgatggcggtaaacaatggcaccctcacctgcttaaacgaaaccatggcaaccacttcaaagagagccaacaggaagatatttattaatattccattagtaaacgaggcgtgaagcaggcgtggtttcaataacgggagttagaaatttaagagatcctcgtgtaaaacatctggtgtccgggggataatggagtcaacatccaggcttgggcacatctgcttcaacaggaggcgcagcctgtcattttcagatgatttggcagaagccacctgcggacaaaaatcaggcgtttagatggggcattttatgtttgggccattagccacctgggcattcgtgttactgtatactgacctcacggtagtgctgcagcagatgcttaaacttggcccggcattttctggaagccacccgattcttgtatcgctttatttctagttcagaatcgcattcctccagctgcgagcaagggaatgcgttactacaagtggtgcctagtcagttgaaacaggccccaccgtccgctgccgccctccttgagccccaccgtccgctgccgccctccttgatcccctccttaccgattctggctgtagtggtttccttgtacgtcgtgccggggcagccgctggtgcaggctgtggagcaccaatgtctgctagctgttgttcttggttagccccggggcaagccaacaccactgctgctgctggttgaacagtagaattgtctccaggttgaggtgcttctcccccggcttggttagtcagttgattctgggttatgtctgagactgggaacagctgaggtgctgcataagcttgataagcattctcaggagcaggctgaggggcaggaaaccacgacccagttggtgcggctgaaacatgataggcagtgagctggccttgtggcagaggctctggcagcaccggccacagcacacaaggcaaaggagcttgtgatggccctcccaggtcctgatagactctggtagcttggtcaaaagcttgtacaaaaggcacctggtatgggtcaggtgtaaattttacatcttcagaagtcgagtttgggtccatcatcttcagcaaagatagcaaaggtggccggcaaggtgcaatgtttagtgagttacctgtctaacatctcccctttaaagccaaggcaccagcctcctctgtgatgtcatggtttgggacgtgctaaatttaggtgtgtctctgaggcacattagcaatgcctgtggctcatgcatagtttccaaaagaggaggaggcagttttcagaagtgtctaaaataagctggtgtcaaaaatagacagcccagttgaaatatgcatggcatgcagcagacattcatcatttagaaatgtatccaagatttcattaagttctggggtcaggggggagtccagattcaaatcctctgtcatggactctagtgttgtggtcagttcgtccaaatggccacgagggggcgggtggttcaggtccatctgtccacatatggctgcttcctccttctggggaataacagtgtcagccatctcccttagggccttcacggcctgactggtttcctcatcagggtcctccaacagatgacttgcctcgggggttactgcgggggccgggtcaagtggcttgggcaccggggctggcgttagggatccgaccggttcatggacaggtcctgtgggggtgggagccaaagaggcaggcaggggccggttggcccacggggatccgggtggatggaagggcctgatcctctttggctgacacacctctcgcccctcgaacacgtcagatatggcactgcccgcttccggctttggcaggaacataccttcccggctatccctgaggcccttcttccttttaacgggaggaagaaaggtgggctttgaggggtgggggaatatgggtctctcatcgctctcttggtggaccgctgctatccaaggctgttcaggttcctccgcgttggaaggacatggagtttgaccacggttgggcctggatgtccggcgcgactttggggcccgcaggcgcggggcctcggccctggcctcttcccgctcgctctgctcggtgtcactgttgcccgagtcactgctgctggaactgctgtcaccgcagtcggcgctttgggcaccgggcttcaggggcatggtcgggctcgggagactttcgagttcatctgtaaaagcatgaaactgtccggactccgagtagcgggcctcggtgtgagaggcacccccatcattccccatgagctcctcgtccatcctgtcggctccggacacgaggataggagtttccactgccttggacttggttgacagcaggcacgcgggaagcacgccgctcacgtagctcctctgtccggcgtggctggagtaggaggcccggggcagtgtcttaatcagagccctgacatccttaacatcgtccgtcagatggcctgtcttggacgagaccatagtctggaacatctcctcgaggacgggataggtgaacacccacttgcaaaaggccttgaacttggagcttaggaggccttccttctccatcctgttcaggtgttccactacctgcttgccggaggccatgatggccgcgcggtccacgcccagcaccttgctgtaggtgtaggcccgcacccgactgtgttttaggagcttgtacatagcggtgcctatggtggcaggaatcatcacccggttgctgggggcctggatgaagaatctgtcagtgaccactatcaggtggtctaacacgtagcgcatcactatagggcacgcgatggaacatgcgtcgttgccggcattctcagcccgtcttcttaccctgttgtttcggagaatggcccaaaaattgcagatgttgagcgtggccattagcccgccccattctcgcccgtgggccttggcctcatttataaatgccttgcatattttgtaggatctcagagtaatctccacactcccggctgtaaattccttgttgaggacgttgcagtagtcagagaccagagagcccagctgctttttgatttcaggagttagcctcagaaagtcttccaagccatcctttttaggcctcatggctagtagtaacagaggaaatgcccgaccattaaaatctttcctccatgagctttacctgaaacactatcccgaagtgggggatgtggtgcatctactgaacaccatcggggtcgactgcgacctcccacctagccacccactcctgacagcccagagggggctgttcctggcaagagtcttgcaggctgtacagcagcacaagctgctggaagacaccatcgtccccaagatcttaaagaagctggcttatttcttagagctgctaagctactactcccccaaggatgaacagcgtgacatcgccgaggttcttgaccacctcaagacgaatcgggacctggggctggacgacagactctgggccctgattaggaaactgcgccaagacagacaccatgcctctgtaaatgtcctcatgccaggaagcgactacacagccgtgtcgctgcagtactacgacggcatctccataggtatgaggaaggtaatcgcggatgtctgccgcagtggctatgcctccatgccctccatgacggccacgcacaacctctcccaccagctcttgatggcgtccgggcccagtgaggaaccgtgcgcctggcgcgggttctttaaccaggtcctcctctggactgtggccctctgcaagtttcgcagatgcatttactataactacattcagggatctatagccaccatctcccagcttctgcacctcgagatcaaggccctctgcagctggataatatcccaggatggcatgcgcctctttcaacacagcaggcctctcctcaccctctgggagagcgtggccgcaaatcaggaggtcacggatgccattaccctgcctgactgcgctgaatacatagacctactaaagcacacaaaacatgtcttagaaaactgttctgccatgcaatacaaataaatttctcttacctgcgtctgtttgtgtagtgaggtgttgtgtcctgtatggtattctactttaaaaatgccggctgacatggattactggtcttttatgagccattggcatgggcgggacaatcgcaatataaaaccctgaccatcacatggggcattaggcgactctgcatcagcatcgcttaagtatgagtgggcagcagagaggctcggttattttggttcctgaacatctggctggggcattaactaagcttatgagcgattttatcacaggacaagatgtcactctttctggaggaaatattgcagtcaaaattcgcgatgctataaaccagacccccgggggtggtgatgtagctatactttcttccctgtttgctttatggaatgccctcccaacatctggtagacaatcctccagggacgatttaatcccagccgccgtgcaggccttaaccacggcccacaacttatgtctgggtgttattccaggtgagacctcacacaaggacacgcccgagtcattgctccgggctatcgtgacgggtctccaaaaattgtgggtggattcgtgcggatgtccagagtgcctacaatgtcttaagggattgaaggcaattaagcccggcctttatgaaatccctaggataataccacacactaagcagtgtagtcctgtcaatctcctgaacatgttggtccacaagcttgtggctttacgtggtcatgtgcagcttgcatacgacgcccgtgtcctgacgcctgactttcatgaaatccctgacctcgatgactccgatgctgttttcgcacgcaccttattggcagccttatttcacctcaatatgttctttattctcaaagattacataacacaagactccatgagcttgaagcaggcccttagtggtcattggatgtctgccacgggcaaccccctgcctgcagcaccggagaccctgcgaaactacttggaagctttccgaaattcggataatcacttttatctcccaacgacagggcctttaaacaccttcaaatttcccgaagagcttctggggcgcgttgttgtgattgattcctctttgtgtgccgccagtcacgttcaggacgttatcacccgtggtggtggggcgggtgttcctcgtcctaggtttttggccctgcccccggccccatcccgtgagccccagcagacatgctctcagttaacgagcagagggaatgaaagctcacggcgaaacttgggccagcccggggggacctcccccgctgttcccccagtttgccccatcgtttccctggcagcctcccgggccaagcaaaaccgcgggggcacgggatccttgcacttagcccagcctgagggaacctcccccgccgtctccccagtatgccccatcgcttccccagcggcctccaggtccaagcagcaccgcggggtcactggatcctcacaggcctcacccagctcttcttccgttgccccagtagcatctctgtctggtgaccttgaagaggaagaggaggggtcccgagaatccccatccctaccgtccagcaaaaagggggccgaggaatttgaggcctggcttgaggctcaggatgcaaatcttgaggatgttcagcgagagttttccgggctgcgagtaattggtgatgaggacgaggatggttcggaggatggggaattttcagacctggatctgtctgacagcgaccatgaaggggatgagggtgggggggctgttggagggggcaggagtctgcactccctgtattcactgagcgtcgtctaataaagatgtctattgatctcttttagtgtgaatcatgtctgacgaggggccaggtacaggacctggaaatggcctaggacagaaggaagactcatctggaccagaaggctccggcggcagtggacctcaaagaagagggggggataaccatggacgaggacggggaagaggacgaggacgaggaggcggaagaccaggagctccgggcggctcaggatcagggccaagacatagagatggtgtccggagaccccaaaaacgtccaagttgcattggctgcaaaggggcccacggtggaacaggaacaggaggggcaggaggggcaggagccggaggggcaggaggggcaggagcaggaggggcaggaggggcaggagcaggaggggcaggaggggcaggagccggaggggcaggaggggcaggagccggaggggcaggaggggcaggagcaggaggggcaggaggggcaggagccggaggggcaggaggggcaggagccggaggggcaggaggggcaggagccggaggggcaggaggggcaggagccggaggggcaggaggggcaggagccggaggggctggaggggcaggagccggaggggcaggaggggcaggagccggaggggctggaggggctggaggggcaggagcaggaggggcaggagccggaggggctggaggggctggaggggcaggagcaggaggggcaggaggggcaggagcaggaggggcaggaggggcaggaggggcaggagcaggaggggcaggaggggcaggaggggcaggagcaggaggggcaggagcaggaggggcaggaggggcaggagcaggaggggcaggagcaggaggggcaggaggggcaggagcaggaggggcgggagcaggaggggcaggaggggcaggagcaggaggggcgggagcgggaggggcaggaggggcaggagcaggaggggcgggagcgggaggggcaggaggggcaggagcaggaggggcgggagcaggaggggcaggaggggcgggagcaggaggggcaggaggggcaggagcaggaggggcaggaggggcaggaggtggaggggcaggaggggcaggaggtggaggccggggtcgaggaggcagtggaggccggggtcgaggaggcagtggaggccggggtcgaggaggtagtggaggccgccggggtagaggacgtgaaagagccagggggaggagtcgtgaaagagccagggggagaggtcgtggacgtggtgaaaagaggcccaggagtcccagtagtcagtcatcatcatccgggtctccaccgcgcaggccccctccaggtagaaggccatttttccaccctgtaggggatgccgattattttgaatacctccaagaaggtggcccagatggtgagcctgacgtgcccccgggagcgatagagcagggccccacagatgacccaggagaaggcccaagcactggaccccggggtcagggtgatggaggcaggcgcaaaaaaggagggtggtttggaaagcatcgtggtcaaggaggttccaacccgaaatttgagaacattgcagaaggtttaagagttctcctggctaggagtcacgtagaaaggactaccgaggaaggaaattgggtcgccggtgtgttcgtatatggaggtagtaagacctccctttacaacctcaggcgaggaattgcccttgctgttccacaatgtcgtattacaccattgagtcgtctcccctttggaatggcccctggacccggcccacaacctggcccactaagggagtccattgtctgttatttcatggtctttttacaaactcatatatttgctgaggttttgaaggatgcgattaaggaccttgttatgacaaagcccgctcctacctgcaatatcaaggtgactgtgtgcagctttgacgatggagtagatttgcctccctggtttccacctatggtggaaggggctgccgcggagggtgatgacggagatgacggagatgaaggaggtgatggagatgagggtgaggaagggcaggagtgatgtaacttgttaggagacgccctcaatcgtattaaaagccgtgtattcccccgcactaaagaataaatccccagtagacatcatgcgtgctgttggtgtatttctggccacctgtcttgtcaccattttcgtcctcccaacatggggcaattgggcatacccatgttgtcacgtcactcagctccgcgctcaacaccttctcgcgttggaaaacattagcgacatttacctggtgagcaatcagacatgcgacggctttagtctggcctccttaaattcacctaagaatgggagcaaccagctggtcatcagccgctgcgcaaacggactcaacgtggtctccttctttatctccatcctgaagcgaagcagctccgccctcacgagccatctccgtgagttgttaaccaccctggagtctctttacggttcattctcagtggaagacctgtttggtgccaacttaaacagatacgcatggcatcgcgggggctagacctctggctggatgagcacgtgtggaagaggaaacaggagattggtgtgaaaggagaaaatctgcttctccccgacttatggctagatttcctacaactcagccccatcttccagcgcaagcttgctgccattattgcctgtgtccgacgcctgcggactcaggccaccgtctacccggaggaggacatgtgcatggcctgggcccgcttttgcgacccctctgatattaaggtggttattttgggccaggacccctatcacgggggtcaagcaaacggcctggcattcagcgtcgcatacggctttccagtcccccccagcctgaggaacatctacgcggagctgcaccggagtctgccggagttttctcccccagatcacggctgtctagacgcgtgggcctcccagggggtgttgctactcaacaccatcctgaccgtgcaaaagggcaagcccggctcgcacgcagacattggctgggcgtggtttactgaccacgtaatttcattgctctctgagcggttaaaagcgtgcgtgtttatgctgtggggtgcgaaggcgggagacaaagcttcactaatcaactccaagaagcatctggttctgacctctcagcatccctctcccctggcccagaacagcacccgaaagagtgcccagcagaagttcctgggcaacaaccactttgtcctcgctaacaactttttgcgtgagaaggggctcggtgagatagattggaggctgtagaggggtcataactatggccatgtttctgaagtcgcgtggggtccggtcttgcagggaccggcgcctcttgtcggacgaggaggaagagacttcacagagcagcagctacactctggggtctcaggcctcccagtctatccaggaggaggacgtgagtgacactgatgagtctgactactcagatgaagacgaggagattgatttggaggaagagtaccccagtgatgaagacccatccgagggcagtgatagcgacccctcgtggcatccttcagattcagacgagtctgactacagcgagagcgacgaggatgaagcaacccccggctctcaggcctcacgatcttcaagagtctcgccatctacccaacagtcttcaggtctgacacccacgccttcgttctcccgaccacgcacccgggcacctccgaggccgccggctcccgcgccggtcaggggacgggcctcagcacctcccaggccaccagccccagttccgcaatccaccaaagacaaggttcccaatagacctacgcgacctgtacttagaggcccagctccacgccgcccccctccaccttcaagtcccaatacatacaataaacacatgatggaaaccaccccccccattaagggcaataacaactacaattggccatggctgtaaataaaatgtcataacctggagtctgcatgtctgttgttttattcagtaaaccagtagtgcgcgtgagttctttagggcatccacgatgtagccgctcgcggggttcccctccccagtgatcatctcggataggggattcctgtccatgaccacgcaattagagtgccgggcccgggacagcgccacatacacatggccgggtttgatgtttctgtggctgccgaagcagatggcgactttgtttagggacagaccctgggctttggctatggtcatggccagctttgagctaatgccatagtcacggatgctgcagaggttcagggacttgtcctctatagtctcatacagcttgttagtattgtgttccaggcagcacacgaagcctgcctcatccttgaccattagcctgggcatgcgtgaactgccagcgtcctgaggctgctgctttcctcggatgccaaagaagacgttgagatgcgtgtagcccagaagcgtgtagttctcggtggtggaggcgtagtccaggaggccgtgaaggagaggctcgtctgaggtgaactctatgttgtcgcgaatcagcatgttgttggtaaatgtgcagaaggggaggtccctgaactcccttccgccatagcggacggccacatccaggcattgcctgaaataggccctgaggtcattatatatgtttaacagggagcagaggggggcagaatttgcggccgggggagccagtactcgggcatagaagacagcggcggggctccgctccccatcccaggcaacctccagcggcagttcgcccagctccatcccagcagtcacctccggatcccacgtacgcccgggcaggggcacagcaccaagctccgccacgtattccccgttttcacagagagaatgtcctccgtggctaaaagcgtagatgccgccgtaaatgagtcgggccaggaagctgtagacatactcgggctgctcatgcccgtgggcctccacgaagctgtccgcctcgagcgtgtccataaagtccccgaaggtgccggtatagccacagatggactttttggtcttgcagttgaccgacactgagctgtgcttcacgtaggtgacattgtaggtgaccttgacccgttcttcatcctgctcggttcccaccgggaccatgtcttggtcggcgaactgcgagtagttaccgaggcgtgcataattcttttggagccaggtgtgggccgtgaggcccggaagaccgaccagggtcttgtactgggccaggggatcgaggaagacctcgcactccaccgggcaggtaaacatggtcaccccgcccccatctcccccagttccccgcgcggcgcgcccctgcccggcagtcttgagcgtggcgtggagggtggtgaggaaggtcttgacctcggcgtgggagaggaagagccgggtccagcccacgtactgcgtggggtccattatggccgccctggggacgacgaagcggtcgacgtaggccaggatgtccggcgagagctcgaggccgtactcgagggtcttcatgaggtgtccaaactggacgtcggtgcagcgcttgttgttgatgaagagggcccagttgcgggccacgtccacgtaggtcgcggccctggggttgcccaccaggaaggtgaggatgttgtcgcactcgcgaatcttgtttacctgggtctcgtggctaaaggaggactgaaaggcgtctgtctgggtgggagagcccacgcagacgatgcagggaatgcggccccggcggtagagtggggtgcgcagccaggcgttgaagaaccagtagcaaaagaccacggctgttagaatgtgcacggaaagcgttccagcttcgtccaccacgatcacattggtggtccatagctgcccctggtgcatgtctctcaggacctcaaaggcggggccagagactcccgagtagagccccctgggcttggttcgcctgaactcggcggcaatgtcggagagtaccggccagtatttggccaggtcccgccgctggagttcctctagggcggcgtccgtagagcgaccatgactgctgacccgctgcgtcatatttatgtggcggctcttgaacccaaaggcgctatagacggttgggcagtaggctcggagtgtctgggagaggttctgtgcggccacggttgtggctcccgagaccaggcagtccatcgtgtggtggaggcagctaacgctggtgctcttgccagcccccgccgttcccgtaattacataggctgaaaagggcaggaaggggggctccgagagctccgggtcaaactcgggggagaacgtctccatatccgggagttgtaggacgcggcgcttagccagggtccctatcctcctgactatacgcctcacggaggcgtctgaggtcatgtttaacatgaacgtggacgagagcgcctctggcgccctcggctcctcggccattcctgtgcaccccacaccggcctcggtccgactttttgagatcctgcagggaaagtacgcctacgtccagggacagaccatctacgccaacctccgtaaccccggagtcttctcgaggcaggtgtttacccatttgtttaaacgagccatctctcattgcacgtacgatgacgtgctacatgactggaacaagttcgaggcctgcatccagaagcgatggccgagcgatgactcgtgtgcgaacagctatgaccatgattacgccaagcttcaaaagcgctctgaagttcctatactttctagagaataggaacttcggaataggaacttcaagatccccgggtaccgagctcgaattcactggccgtcgttttacaacgtcgtgactggccggcggcaacaacccagcggcgtcagcccccgccgcagttgcggcagaagccgcgtctgtagatatactgacgggcagcaccgcctccgcaatcgaaaagctgttcaactccccgtccgccagcctgggtgccagggtgtctggtcacaatgaaagcatcctaaacagtttcgtttctcagtacatccccccttcgcgggaaatgactaaggatctgactgaactttgggaaagcgagctgtttaacaccttcaagttaacacccgtggttgataatcaggggcagcgtctctacgtcagatactcgtcagacacgatctctatattattgggccccttcacctatctggtggcagagctttcaccggtggaactcgtgacagatgtctacgccaccctaggcatcgtggagatcatcgacgagctctaccggagcagtcgcctggccatctacatcgaggacctcggtcgaaaatactgccccgcaagcgcgaccgggggagatcatggcatccggcaagcaccatcagcccggggggacgcggagcctgaccatgcaaaaagtaagcctgcgcgtgaccccccgcctggtgctggaagttaaccgccataacgccatctgcgtggccaccaacgtccctgagttctacaatgccaggggggaccttaacgtccgagacctccgggcccacgtcaaggcccggatgatctcgtcccagttttgcggctacatcctcgtgagtctgctggactccgaggaccaggtcgaccacctcaacatattcccccacgtgttctccgagaggatgatcctgtacaaacccaacaatgtgaaccttatggagatgtgcgccctgctctcgatgattgagaatgccaagagcccctccataggcctctgccgggaggtgctgggtcgcctgaccctcttgcactccaagtgcaacaatctggactctctgtttctgtacaacggggccaggacgctgctgtccaccctggtcaagtaccacgacctggaggagggggctgccacccccgggccgtggaatgagggcctgagtctctttaagctgcacaaggagctgaagcgcgccccatccgaagcccgggacctcatgcagagcctctttttgacctcggggaagatggggtgcctggccaggtcacccaaggattactgcgcggatctaaacaaggaggaagatgccaactcgggcttcacatttaacctgttttatcaagattctttattgaccaagcatttccagtgccagactgtcctccagaccttgagacgcaagtgcctcgggagtgacacggtctcaaaaataattccctagaataaactgagaacagtcatcagtaaatctgtctctcgagtgatttccataggcatggcgtagccggggtggagggccgatatcacatcaagcagaaaggccataatctctcgaaagtaggcggtggggctgagaccatgctcagtggccgtctggcagggggccgggcgcgctccatccttgtccaggagacacacgtggcttccagagaggcgcagcccagccctccgcagccgctgaagccaggctcgcggaagagcccaaaacctgtttcggcgccgcccaggggccagtctccgggtcaggtcgcggaccagggtcaacaggtggtcgtgggatggcggggccttgtctgcctcgggtctcgccgctagttggtccagggtccaggagaaggcttcgtgccagaccaaaaagggccccgagtgctccctacatccacccacgtaaagatccccctgaaagatggccatcagtaggcacgcgggcccgcgtcgagccttcacccgaatgtgtctgcgggccacggtggcctctccgcccataacatcccggtcgagccggctggcatcctccgagtctttcacaccttgcaggaaagcctaggtgatacagcaacagaaagctattagctggtggttcccccaccatcattcttcctgttaacgggaagaataagagttgggcaaaccccgggggccgcgctctcccacccagccccgctcctcacctgtgctagtggctcctctgaaggatgggcggaggttgttgccacaaagcccaggatgaactcgtctgcataagcccaggtcagtcctaggtcagcggccgcgtggaggagaacccgggtgacggcggtgtagaggcccccgagtgcccgtcgcgtgtctgaggtgccatagcggtgaagggcccgcagccaggtttgcgcgtcccgcgcctgccctccgccatcaggcgttcccacaggggcgcccctggcagagaggtggcagcgggccaattcgtagagccaccaagtggcatcagcctcaaggatggctgtggcctccgcgcgcccaaccaccgtcgtctcgtcctccccccctccctcgccgccctcccgcgtgcaaacgtggcgagggttaatctcctttcgggtcgggggccagatttgttgtaggagcagcgagccgcgtcgttgccctgaccgcgcgtcgaggcccaggagggcgtctgccaggggcgtcccagagactcccaggttcaggtccagtagcaggagaccctcgctgtgtggcgcccggtgccagaaggccggcctcgcccgtcccacataatggatgggcaggaagggaaagcccgggacatagggctggaaatctgagccccctgggcagagttcggggtccaggaggtagaagatgggcttggtgcctctgtggttggcgtagcaggaggcatagatactgcggaggaaggcgtagagcccgcccccggccatactccaagagttgacaagccaggactcgaatcccccagccggctcgagaattttcaggctgacgcggtgccgtcgggcgtccccaccacggccggtggccccgtcggacgacaccagatctacttcataagtgaccggtcgcaggatgtccctaaaggggacgggagaggggtcgtcgggagtctcggtggaataggtgaaaacatccccacgcggtgtcctgatgtatacgtccaactgtccgggagactcagagtgcctctgagcatgggggcatgtctgttccccctccacctcggacccgaagccatcaccaggtgggggttgttggtcccgcccatcatcccccgagcagctttggcagaccacctgtgctggaaagagaggctggaagatgaggccctgctcatcctccacccgggcagcggacaagagtctgcggtctcgggttctaaatgaaaggtcaaataggtccttctcggcggcatcggcgagcatagcaatgagccccccgctgcgcctgagctcccgctcccatcgcaaaaagttgagttcggtagtcgagggcgcgttgaccacggggggctccagggagcctccaagcggcggctggcaggcctgcaccacgatcagagtctcaacgtcctcccttttgatgggcacgatgcccacgacccaaatcgcccaccaccgccctgcggtctgggtgacattataaaaggtaaccgagctgacccgggccctgacgctctccgcgggtgtttccatcattgtttgagatctgaggaggactggaccctttaaaacatccggtcacgccctttgcaaattatttaaaaggtgaatgctcaactgagaccatcgcaatcatgaagtcctccaagaatgacacgttcgtctatagaacgtgggtcaaaacgcttgttgtgtactttgtgatgtttgtcatgtcggcggtggtccccatcaccgccatgttccccaacctggggtacccctgctactttaacgcactggttgattacggggcacttaacctgaccaattacaacctggcccaccacctgacccccacgctctatctggagccgccggagatgtttgtctacatcacactggtctttatcgcggactgcgtggctttcatctactacgcctgcggcgaggtggcgctaatcaaggcccgaaaaaaggtctcgggtcttacagacctctcggcctgggtctcggcagtgggctccccaaccgtgctgtttttggccatcctcaagctctggtccatacaggtcttcatccaggtcctttcctacaagcacgtctttctctcggcctttgtgtactttttgcactttctggcctcagttctacatgcctgcgcatgtgtgacccgcttctccccggtctgggtggtcaaggcccaggacaactctattccccaggacaccttcttgtggtgggtggtcttctacctgaagcccgtagttacaaacctgtacctggggtgccttgccctggagacgctggtcttctcgctcagcgtgttcctggccctgggcaacagcttttactttatggtgggggacatggtgctgggagccgtgaacctcttcctcatcctgcccatcttctggtacattctgacggaggtgtggctggcctccttcatgcggcacaactttggcttctactgcggcatgttcatcgcctccatcatcctgatcctgcccttggtcaggtacgaggccgtctttgtctcagccaagctgcacaccactgtggccatcaatgtggccatcatacctatcctgtgctcggtggccatgctcatcaggatatgccggattttcaaaagcatgcgccagggcactgactatgtccctgtctcggagacggtggaactggagctagagtcagagccgaggcctaggccctcgcgcacgccatcacccgggcgcaaccgccgccgctcttctacgtcctcatcttcctccaggtcaaccaggagacagaggcccgtctctacccaagccctcgtctcctccgttttaccgatgacaacagacagcgaggaggagatcttcccctaatgcaataaaaacttaaaacactgaggttactttcccgtcattctttcgggggaacgaggggaggcgggaattgggttaagataggggcgaagggtggggtgggtgcgagaattggggctggggagggagaggggagtggcctcggtgccgacgccggggtaccaagataatggattgagtaagcatggtgctctgatcgggtccgccgggttctcgggggtgtagtgggtgggcattgcatatttttgccgcggtgctgttgggccttggactcggggtgatcacccgcacccgcaccccagtccacagccaccggccaaggtcctgggcctcccaccaccgttatgcctccccctttacccattaattacaagagatgttagtttggttttttatttggcaaaaacagcaattcatcattttcagagtcctcatcatattcgagcccctcgttggtttccccgcaggccctcccttcttcgaccgctattagcttagtagtctccaggttaaactcctcatagtcattatacaggttgattattcccccgtccacgtcgcctatggagttgactcgtcgtcggcaaagagaccagagggcacccatggcgcggtgtcaaaagtattgtctgcgtacgctttccaggagccagccgcggtgctcaaggtcttacggatgacagagtccggcaggaccacgggtgtcaccagcaccgccacgggaatctccaccgaggcgtccagaagcaggtctgagccgagcgtgcaggtcgccgggtctagaggcgaccgttttcgaaagaaggccgtcacaatgttcacccggggtgagcagtctctcccgggcttgccacccccactgtggcggacgtagtctccaacaattttgtattggaggagcacctggtagaagtagttgtgccgtggattgatgaagatgttgactgggacccggtctttaataccaatgcgccccgcattttcgcttgggtccgtcattacgtagagcatagactccacccccctgttggcagctaggctgtctgccaccaggtcatgaccggggcccagtttgcgcttacggacatctttaagattccaggcctcatcctgcgtcaacagatagtcaccctccgagggcaaccgcccatccgggacgtactccacggtaggacgagctatagaattgataaatctgataaatgacctcttgcatggcctcttgtaaagcgcagtgtaggatgggtagatggggtcaaactctgacttggaaaagaggtacttgaagcggcacttaatctcataaatgcagctccggtcggtgaacagtataaagtctccctgtgactccacattgacgcaaagatccagagacaccccaaaaatgccatccgtgggactaatcataaagccaaattgacggttggcggatgcgtccccgcagatgagcttacagacaatgtccttgaccgtgtcctcacaccgcaggccaaaggcaacaggtcccccaaagtagtgatttgtggagatgggagctggctcaaacaccttggtgggtccattcttaatggtggagagcagcttggaagaggaaattatgccatttcgcaatatgtcccacatcaggttctcagactgccccctggtcatggactccacgtacgagcagagaacagtcctctgctcgtcggtggcctcctgtagcccccagtaaatggatttcagggagggaccgtcctggctgtcattctcttggactaacgaggagacaaagtcacagaagccagtttcaccagagaactcttgtatttgtttacagaggcaatagagatagacatagcgcatggccggcatctgaggtggacggtcaaggttacggacaaaggcctcagtctccggactgcggaggaagcgggcaaacgtgtaggaggtcatctcctccatgggatcctcgagctcatccacgtcggccatctggaccaaagaagtcgtctgccaagagttcagctaccagacctggaagatgagggtgctcaaaccgtgggcgacagttgaagaagtagctctccttgaacctctttttaaggctccggcaccactgcaagaattgactcatatgctccgccgtgacatccacgcacggactctcgccacacgaggtcaggcccatgtctaagttcaggttccacatctgcgacagcacctccaacagcaccacctttggggctgcaaattgcaaaaagtagagcgggtcggatcggtcaaatcccatgtcagggttggggtaggggattttgtgggtggagtcagcgaggtgcatgataccatagagcagcgagtagccgagcgactgcagatccaggcgaagggccgtctgcgcccccacggggccacacgccgaggggtcagggatgtgcccagcccccctcaagatgtagcacttgctcaaaaggcagaggggcttataggtgtccttggctatagaaaatggttccctctggcaatagaggcgatagagctgccggcccttagaagactttagccgcacatccagcatcttgttgcggtcgtggagggaagcagtcccataatcagtcaggaccagcctccccatgccccacatggtgtctgtgaaatccaccaggatgttgctggggctaatgtccgaatggaagaggccgcagtgccgattcaaaaagtaaacggcatctttgaggccctgaaagccccgcaccaggggctcaatactaccatcatgccagtggccataatcctggagactgcatctgaactgaggcataaacagggcgtggcaggacgtgcaggccgacaggtagtccaccagggccttgtcctgcccgtcctcggccgtggccttcccaatctgaatcatgtcacacaccatgagctcgtgatacagctccgtcacagagtcatagagtttgactgtggcattatctgcatgtgcatacacggccccgtagctcccccgccccagcagatactcgcaggtaatggggaggtgatcacagcgcgtcatgttctccggcagctttacatagagggtttccgtcatgtcatcaatgttggtcaccttcaggtgtttgtgctgaaaggtgaagtaatcaatgacagtcaccttccccaaaaaggcctgggtctctcgagggggttctggggagacactcaactcgccactgctggaggagttcgtcgggctcaactccgcagccatattcacatccatgttcctcaaatggctcgagggcctgtcgcagctcgtctctggcctcaagctcctgctcacggagctcctccacccgctctagctgcttgtagttgatttttggaaattgagtcttggtcgcggtgaccaccctctgataggtagaaattagctgtttggactcaaacgtctcccttgcgcggcgcagggactctaaggcaccccgagcagatgtaaactgtgtttcaaacagagcgtggtccctcccaaatctgtcacgtgcgctcacagccgctctcttttctaccgaggctcttagttgctgggccaccagatctcgcttagaactactcatcttcataagtcaccatgtccgcaactatggagccgagatcatacgtggggtagagtacggtagttccagtggaggcttcccggtaatttcccacagcgtccaccatatatctttctgcctctcccgttagaattaggcaaggatcatacgtgtccaccggccttttatactgagcgtttaggttttgtttatgtagcaagcacaaaaggcacacacgagtgatgcaaaagggttcctgaggcagcaggcagagctgttttgccattttattcaggcggctaacgtcaaagggaggagctatatcctcacccttccagtcacgcacgtccaagtacagggcatacacacacctggtgaggtgtgccaggaatgcctctatgttggcacatggtgtataaaccgcagtgggtagcagaatagggcccctcttgccccgtgctgcagcgtaaacacagtgacgctcttcgcagtgggacctggggccgtagaagagggcccacatccaagggagtgggtcttcaggcaccagggaggtccaggtatgggagtgggccaatatttgcaaggcctgacctataacctcatctttgttccaggccagcgcaattcgcataaggtccccatcaaacacctcaaaacacagacccatgcccatttcaggctgagagggctccatccggctcgaccacccttgtccaccaaactgccattcttctggtaaacgggggttgaggggcaagagctccaaagccaggctcgagaagtcatagtcatcctcggccacacggccggagctccgggcctcgtgccagggcctgttgtcctgagggaggatattggacacgagcaggaagctcttgagtggcgtctccaccagcttaaattgctcgggcgtgtcctggcaggcctccagtgccagttccagacactgcccatacctgcgggcgagcatcgggtcatcgggcatatcggccttgaccgcgttgaacatgctgtatgcctcgcagcgcggccgtctgaccgagaacctaagaaacgcccttcagcaggacagcaccacgcaaggctgcctgggtgccgagaccccgagtattatgtacacgggggccaagtcagacaggtgggctcaccctctggtgggcacaattcacgccagtaatttatattgcccaatgcttcgagcatactgccgccactatggccccaggcccgtgtttgtagcttctgatgaatcattacccatgttcggtgcgagccccgcccttcacaccccagtccaggtccagatgtgcctactaccagagctacgcgacacgttactgcgcctgctgcccccacccaatcttgaagactccgaggccttgacggaattcaagaccagcgtgtcctctgcccgtgccatccttgaggaccccaactttttggagatgagagagtttgtcaccagcctggccagcttcctgagtggtcagtacaagcacaagcccgcccgcctagaagcattccagaaacaagtagtgttacattctttttattttctgatctcaatcaaatctttagagattacagacaccatgtttgacatctttcaaagtgctttcgggttggaagaaatgacgctggagaagctgcacatttttaagcaaaaagccagcgtgtttcttatccccaggcgccacggcaagacctggatagtcgtggccatcatcagcctcatcctctcgaatctctccaacgtgcaaataggctacgtggctcaccagaaacatgtcgcgtccgccgttttcactgaaattattgacaccttgaccaagagcttcgactccaagcgtgtagaggtcaacaaggagaccagcaccatcacgtttaggcacagtgggaaaatctccagcaccgtaatgtgtgccacctgcttcaataagaatgtaagacctgacgtttcagtacttggcaattgtagagcatagcccggctgtaaaggtcagaaaatcgcagcagggtccaaggttgtgctgtacatgggacctctttcccattagcaagaaccccctgcaggacgcgtgacatgtccgggtgcattttgggtgggttaaatctcagtcccaccacaaagggggcatcctccggtttgaacatcagacccaacaaagcccgatgcccagttatgggtacgtagtcgttgttcagggccgtgcatggcagcagacaaggacaggtgccagatgtgcctgggctatcgtcctccgtccagccacgcaggatgttcacgtgggccccggcaccatagcatgtcacacattccccgttatcacatctggttagcaggttgataaaatgggtcagtgatggaaaggttggcatattggggcagcacatcagcatgtccatgttaacgaaaaacatgtacagggccccttctgcataccaggcaccaccccgtcccagtgggatgatctccgagggtgtgatatcttgcagttcttctactgttttaacggcggttgaggtggtaaagacgtgggccgtggtcagatctgtgcaggtgactacagggttacccctaatctccacaggcaccgcctcacccactgcatctgagaataccccaaagtacatgagagtcaggctgtgtggcccctggactgccttagtgaagagaacctcgggcctggccacggtggctagggttccattgatgtagacggtcacataggtgggcttcttcttgggcttcagcacaatgagggtaacattcatgtaggttttaggaggtccggctatctgaggcacgtacacagctgacacggcggttgtggccgtatagactttcatctggggcgtagaggcatcgctcagcacccagaggcactccttgttgaggaacttgcgaagctgttcccggctactgttcgcggcggatgccatgacgtgccagaatatatcccctctcctcgggggtgagtgccaattggcctttaataacaaagcccccaggcagcaccaaaaatgcctgcccgtccgatgtggtggccaggtggacgcagtgcccgtcagttccaagggctactagctgggaagcagccccaaccagcccaccgggggacctggagtcgatcaccttaccccaggccgaggccccttcctcatacagcgggtggctatctatccataggcaggcatccggcgtctttggtgcattggagatagctttcacccaacaactttcccaactaacccgtgtctggacagtgaagaacgcttccctgatcaggtctgaatttttatagatacgggagtaggaggtgggaataacaactgggatttcttgttgtgctgtccaggcctgcatggccagtttttccctgaagctagcagaaattctgagggccactgaaatgaggaagcgaaactccctctctggagctcccaaaattgaaacctcagcaagatctgttgctggggaggcatgggtgacagctgtcatcctgtgcagtctgccctgggcactcagctctggatatgtgacaacatagagagcgtgggggctaaaaatatgagcaattcccctgaccagggccctggactcacgaatggcccgacgggtcttagagaaagaaacaggcaccctcgagggtgcccccgacccgacacccacagtgccgccagtccctgctcggcctccgccgccttccccaccggcgctgccccggatgttgctggggttctcgagggctgggtggtgcttgggcacagaggtctcagcagccgccttggtctcggccccggccctaagtctgagtcccaggcaaagggccggactcccagcgtggcccaacctctgctcccctctattctcctcttgcgttatctccaatagaatttgcttgaggtcatacgttttagggtgctcgacctgggccgcggccaccggcatatgctctatacccgcccctccggggggcccaggatctataggtatgggctgcatagccgcagcagactcctggaccccagaggcctctctgatcagatgcccgtcggtcagagcgcttttggccccctcaaagagagacaggtaataaatctgtagctccccaaccagccctccttcatcgtaaaatcgaagggcggccacgtggaaggggttgtagagctctggaaggccctcctcgcagtacactggcacactggtaaacgtgccccgatggctaggccgtccgggcagcatgccccgagcagcaaacacgcggcagaccctcgtgagacccgtccggtcactgaagagagtctggcaccaggccccctcgcagtttggcacgcgattggggcaaagctctgccataaccgtgtcgggaacaaataggtgcacgaggaggggggtcccgaggccactcaacacttggttgtcaatgtggacatccatagctctctcatgcgtttggctacagcatcatagcgcttgtttctggtggatttaaataacagggccccgtagacagtcttttgtgagtaaatagagatgatgacatggatgtagagactgaggaccacatccaccaccttctcggaggaggcccccctaaacagcatcaggcagcaagggaacacaaaggaaaccagggccgggatgtgaggcctcagggccccctcctgatcaaagagggcctcgctgaccccggagatgacattctcattcagaaagtagtgatagaggtgattgaccacagtcttaaccaggccctggacttgttcaggctcccacttgtcccgctggtcctgtgtgtcttgtcggatctcggtccagggcctcagcgccggctggaaatgcggccccatgtagttgcctgtaagggcgcacaccactccctcatgggtctcaatcagggtgcactcgctggatccatcacatacgtggtactcgccacagccccagcaggcaaacacggaggccatgctctcaggtaacgggagatggaactccagcttactatacgagcacaggtggcgaggattgggctcatccgtgcccccctccccccgcgggaggctcaatcggccttggtctgacattccaccccggccaggtccaggagggtgcaaatattctccaggcgctgcacctcagagacctcctgctcaaagagacctcccaccgccacgtagacgcgggccaccgtccggggaaggtcagtggggtcccagctcagcaattctccaaattctctctccccaatagtgactcgcttcttatcctgtctttcagagcatccgggggcagacatttcacctcttgtttgtggacgaggctaactttatcaagaaggaggccctgccggcgatcctgggctttatgcttcagaaggatgccaagattatcttcatctcgtctgtgaactcggctgaccaggccaccagctttctttataagctgaaggatgctcaggagcggctgctgaacgtggtaagttatgtgtgtcaggagcatcggcaagattttgacatgcaggacagcatggtctcatgcccctgctttcgcctgcacatcccgtcctacatcaccatggacagcaacatccgagcaaccaccaacctctttctggacggggcctttagcaccgagctgatgggtgacacctcctcgctgagccagggtagcctgagccgcactgtgcgtgacgatgccatcaaccagctggagctctgccgggttgacaccctcaacccccgagtagccggacgcctagcctcctccctctacgtgtacgttgatccggcctataccaacaacacatctgcatcaggcaccggaatcgccgccgtgactcacgacagggcggaccctaacagggtcatcgtcctgggcctggaacacttcttcctcaaggacctaacaggggacgctgccctccagatcgccacctgcgtcgtggccctcgtctcctcgatcgtcaccctgcacccccacttggaggaggtgaaggtagccgtggagggcaacagcagtcaggactctgcggtggccattgcctcaatcattggggaatcctgccccctcccctgcgccttcgtgcacaccaaggacaagacgtccagcctgcagtggcccatgtacctcctgactaatgagaagtccaaggcctttgagaggctcatctacgcagtgaacacggccagcctttctgccagtcaggtcaccgtctccaacaccatccagctctccttcgatccggtcctctatctcatctcccagatcagggccatcaagcccatccctctccgcgacgggacctacacctacaccggcaagcagcgcaacctctctgacgacgtgttggttgcgctagtcatggctcattttctcgcaacaacacagaagcacacgttcaagaaagttcattaaactttattgactacaccagtcccttgtaaagcgatgggtctcgcgtgacggcattcgtgagcagggcttcgtccaggggcttgttcttggtggacatcattagcccagctgcaaatatcagaattagcattagaaaagtgagtcccacaaacaccagtgtccagagaggaagaccgtaagataaagatggctgcctctcatctggaacggtgggaagctcagcagttgtttttgtggcattggacgtccctttggaggacagcgtgggggccaaggtggtagcgtttgtaatccgtgtagtagcactggcggtggtggaggacctggtggtgacattgctagtcacgcccgtggaggttcctgttccggactcggtggcagtgatgttctgtgcagtgaccttagtggtgacattgatggtggatgcgttggaagttgttgggactggtgtgacagttgtcccagtggatgtcaccgtggttgtgttggtgctcaggagagcagtcgtggttataggggcgctggtcgtggtcaaggtcgtagactggtttgtgctaggacccgatgccgatggtgatggtgtagtcacagccgttgtgcctgtcacgttccccgccgaggccgtcgaactgccactagatgtccagataaggcttgtctcacagatgagtatcatggccaggacagcgcctgccttgtctctggcgtgtgccatcgcgtctggacgcagaaggcctcccggcctcttttatagctagtctccacacccaatactctactgaaccatcacatacatgacctcctcgaggtatgcagggaatgagcggtccgtgagccggtcaacacgacattgcttccgtttcatgcctccagctgcccctgaccagttaggacccttgacggatgtctttaacggcgcggtgcagttggtcaccaatgacggcctaaaggccaacacatccttgaagcagggcgtaggaatggtaccaaactcggggcccaccccatcaaagacataatatgtctcatagtggcagtgatgatgcatcaccaccacagcactcgccaggaccctctgcatatcttgtacaaggcgcctttcaactcggccactggctctggtgacgttaaatgtcctgttcctattagtcacagcctgtagatttgggcacccagactcaaaaagtgcagctacatgaagggcagccgcctcaaatccaccatgacccccatggctgtccgtgttgttggggtaataagtcacattgttaatgaccacggccgggataagggtgtaaaccttgcagaatggattggtcggacacccataagacaggggcaccccaaaatcgcggcccttaccccgaagcaccttggcccccaccggcataaagctgggcaaaaagagtgggttaaaaccaaaggcgagtagggccaggaacgccaaatagcagcagtaatagatgaaaacaaagctcagcatgaaacagcgtggaggctcagctagggtctctgcctctccatcatagacatcttccttgaatctcattctctcaccgcatacctcactcttcatccaggagggggccatggctgccattctaccagttaacgaggagagagagagtaggtccgcggaaattggtgcccctctctgccctcctgacgaggccatggtgtcatccatctccgcagtccgttcttcagctttggcattggtccgtgtccgggtggtctgattctgattctgatcctgggtattggtcttggtctctcctcccccattggcatggattggcataggtgggtgtggctcaggctcaggttccggccctgggacggcagcagccgccgggacggtgaagtcgtggaaggtagaggcccgtccctcccgaggtcgtggggccggagccttataaaagacttccaccctctccccgctggccaagacacgccgctcgtggaccacgccatcttcctcccggctgattgtgtggctgacggtgccgtgttccaccgccacttgttcatcgaccatggtaccccctttatcttaaccagcaagtggccgtcagggtctcttgagagtatgccgctgtggccaagcgaggccccaaattaaatagtgatgccaaagactgtaggtaggtcatcatcacacgcatgcgtgataaatcatccgccactgacaggtcatccaggtctatccgggctatctcatccggcaccatctcctggaagagattcaagaggtcgtgatgctcatgccggataaggcctcggaccaggcgcatacttgccctgggcagcagggtcaccatgatgcaaaagtagagactcagattgtccagcagggccaagccaaggggccccggcacctccgggagggccaactcgtagtggtgccccaggtatgaaacagagccaagatgcatgtgtacatcgagcatgtctgcgttcccgggagcctgcatgacaacccgggagtacacgttaaacaggagaatcttctgcagcacctcctctgctatgggcgtaggcagcaccatggggaaaacaatgtccacatcattggactctaacttcacggtggcatgctctcgtccaaacaccgggggcataacactgaggctcccggtcccatgccactggaaaaagggctggtacttgttcttaatggcgtaggtctgacctggaacaatcttggtgagtatcaaactgtccacgctaacctcatccagcacggccagggtgcaatcagacaggtagttgtacatggacacgtagtccgggaccgtctctagagagtacacctgacccaagcccaatccctgcacattctgcgtcccgtgagtggaagccaggggtaagatgcagccaatcctctgttgcatcttggcaatctcatcggtatacagacgagaggagagagacactaccactttcaaatccatctttattgacaattatcaaaaaaccaccttatttccaaactttaatattcttcgtaccggcgccacctcttcaattatatagtgtccgtaatggatgggggcgtgggtctgtttgacagacataaactcatcgatgagtgcccgggaggaggctgagagtgcggggaatgcctcctgcagaaagctgcagggctgctccagaaacacgtcagtgccagcaatcactacaaactgcacctctgtgttgctggtggctgggtgccctccaagtcgctggctgtactcgttgaccatgttgtagagccccctgttgttgcgcagaagctcctccttgttgaaaaatgcccggcaggggctgtagaggcctgggacggccgtctggcgataggaggagttgtacatgatgtcgcccagagaacccagctgagatgcccagggattcacagtgctccggtattcataggcggcatccgggcgagaatggtcatagatgagcccctcggcaacctcctgattgtagttttcacaggagaccacacaggcggcccgtccccttggagagttggacttttgaaaataagccacgtctgccgtgaccggtgttacgataatctcacaggtggcctgctggccgtggcagagtcctggagctccattaacattagtcatacctgccaggtatgtcctggggtcccgaagcagtgtcccattgcgctgagcgcccaccttggccttgatgtagtcgttgacttgctggttgccaaaggcctcggccggaaagacgctaaagaagtcttgggtgtggatacccatgtcagtagtgatggccgccaccctggccggagtcatggtcgagctataactaagcccggtgtcgatggaggccatctcgtgatgcacctcaaaggttaccgcgtccaccctggcctcccggcggctgacatttggggtcccaatgaacatggatgttgaggccctggagctaaacaatatgttttcagagaggatctcatcggtcctgaccacggtcatggccacccctgggtggatcttgagcttggcctgggcaatataggccatgggggacatcttgatgtgcatggcggtcattccactgattgaagcgagggaaggaagacattcggccgcgtatttgcccatgggcgagcggtgccactcccggtactctgcaaagagctgctctggccggttgaaggcttccacggcccgctgctgaggattgcgcataacaaaggtggcaacatcctggtgcatggtggcagccactcgcgggtccccgtaaaacatatggaaaggaatggcatggaagagacactgggtgacagcccgggtcctctcggagaaggcaaaggccaccagcccgttcaccaaaacagtctgctctgtccgcttgtcggcgggattcggggccagctgctgcgtaacgtcattgtccaccgacacacgcacggcgcgggtgaaagtggggcaggtcatgaatgaggcgctgaggtccctgatcatgcccacggtggggcggaggtcggagatctccagcagatccctgagcgtcccattctccaaattgtcgaggatgtcctcgtccctggtaaaatggtggctgaaggctggcccgttgtaggccagggtctgggccacgtgctgaaagtccaccccgaggccgcacatgtgggcattggtgcaggtcgggaggaaaacgtagtaaaagatcttttccagcacatccgcatgcccctcatctacataagggcctaggtgcagacggaaatcgtggtcgtggtccccgttaacccggtagccgtacaaggccacaaattgggcagccatctcatccatgtttccaaccctctcaataaactggggcgcggccagggtgtcagcgtaaacctcatttccgataataatctggggggcccggtcactaacggtgagaagatgggtgaaaatgtctgtgtaggccaccggggggagcaggttagggtccaggagtgcgcagacatactgacccacgctctcatcccccacaacatctgacccggccaggcgcatcagggcctgctctagggctataagttccccatagatttttctatacatggaataggcctccttggagatggcgttatttcccaggtgacggcagatgaacttgatcatggaaaagctgttcacaaaggcaagcctccctgcccgttcccagtaggtgttgatgcacagggacaccaaaggcacgttcatgacaaacttttcctcaaacccgtggatcatagcctcaactacgtagaagaaggctggataggcagtgtcataggcagtatcctgcacagtctcaataacggcctgatccaccacgtgggccagagatgtggcggtctcaaactgctgcccccgggcctcttggaatgcagctggggccaggggagtcggcaggttacccaccattagccggtgcacggccctgtgcctggccctctccccggcatccctgccaatgtaaatatcataaagggggtgcagctccagccgcagcaggtcataattggacgggtggaggaagtcttcggtgggcagcccgcacttgagagctatatctgtcacgggggctgcatacttgttatcatagaactcgtccacaataacaagcacattcatgtgattgggcctcctgtgttgcagggagtaggtctcgcgcctgtctcgcggggccggggccgcgttgaggctgtttagggtatgggcgggtgtgtggagtcgggggtgacagagaaccttgagagcattctgtaggttaaacgcgaggagaaggttattcttgtttacgatccatgcctccaccggtagctgctgtgtggggttgtccagcattttgatggcggcggaggtcgtatacttgggattgggcataaacaggcccactgggaaatagtagctgtactgcattcttctgttgagggggtatggggactgagtgtcattgtacatcttttgcaggctttccacggccaccgcgtggttgcccagcttgatgacggcggctgagatcggcacccggggctgatcctcgacccctgcggccacagccggcaggtcagacttggtgcttccggctttttccggtgagtccacgatcctagccatgaaatgctcaaacgtacgcatcacgcgcccgtagctcacggcagtgaccaggttctccccccgtaccacaaaagaagcatagctcgagggccccatgatctggttgtcggcctcctcacccaggaaggtcaagagctggcgcagaacgttgtcggtgacaataaacaccccccccactggctctccccccttggcggtcgtgtaggtactgacccccttgagcacgctctccccggacacggccgctaccatctcagagagacggcttcgcacgtactgagaaaacccggagcccatgttctcggcccggtccaggaagaaggagtgctccagcagatgcctcttgaacatggcaatgaggtcagacttgacagtcttggagaaccccctctcagtgaaggtgggatccgccagggtctgcaggataaacatgggaggggcgtggcgaagcttcacactcaggacggtgttaatgaggcccctctccagggcatcgaccccaaactgtagggccgaggccacggtcttgacagcccccacgtactctgcgtactcgaccggggtctcggggatactatgcaggatctccagatccagcatggacagttccatttccgtactaatgtggtgtttgtggcaatttttgaccacaatgaatgtccgctgcttgctgggtctccttccgtccccgtgagcaatggtggggacggagattcgaaattgaatcttgccatccgtcatacgactcaggtctttgaattctgtgttcacacaggacacggccagtgccgtctccaggaagcgaacatattggatggcgttcgtgtagaccccgagtagcacctcaaacttgatgcccgcctctctggcatccttgcccaccagcaggtcaaagctatgaaacagcccctcggccgctgactgccgcaggttcgagagcaggtcggcatccaccgtcagataggggaagggtctgttttccacaccctcatttgaggccatgacacaaggtaagagggagatggggggaggtctcgagggcttctcttcacagctgggtctcttttacgccctggcctgcaaccgcagcccacctgcacttcccgaggatgctacccttctaatcaaatggttggacacggccctgggcagggaggccaccttttacgcgtgtcgggctatgcgtcgtcttctactcggcgttatccgaataaatgactgccaggagctgccacccggtttaataattctgagtccgggcaccgtccctggcccccttggagtccagagtctggagcatacagactgcgaaatatggtcctctgcccaccctgaccacgctgcccacctcccggtgcccagggtcatcacatacaccgactgcccgggttccataagcacgagctcaatgtttcgccttatcatccgctacttgtctcatcaccaatttgagcgctgcttcgagcagttctgccgcgtggtcccgcgtcgcttcctagggacctgtaagcaaaactctgcaaagatgctggctcatctgaagcaggttaccaggatccccccctgtccgcccttcagcgggcgggaggccagactcaagttccacttcttctcctggagcacattcatgctgtcatggccaaacaatgccacactccgggagatcaggacgagggccgccaccaacctcacccaccacccacatctagtggacactctgtaccacgcctctccgcagaccccatttctgacacgcagcggtgctctataccgcttcgtcacctgttgcaactgcaccctgcccaatatctccatccagcagtgcaaggccggggacagaccgggggacctggagatcattctacagagtaacggcggagggaggcctgcgagcttccagttcccctcctccccaaccggcgccctattgcgatgcatagttgctgcggccctgctgccggaggtgtccgtggggcaccaggagctgtctccgctcaggtccagaagccagggaaggcagacggatgtcaggtcgggcccggacccggcacggaggctggtggccctcctgcgaagggaagatggggcacctaaggacccccctctgggaccgtttggacacccccgggggcccggcccggccaagagcgaagacgaggagtctgagcgtcgagacgcccctccacccccgctcgatttcagcttccaagcttcccggttggtgcccgtggggcctgggtttcgcctgctcgtgttcaacaccaatagggtgatcaacactaaattggtgtgctcagagcccctggtgaagatgcgagtttgcaatgtcccccgcctcatcaacaactttgtagcccgcaagtacgtggtgaaagagacggcgttcaccgtcagtctattctttacggacggggtgggggccaacctagccatcaatgtcaatatcagtggcacctatctgagcttcctattggccatgacgtcactgcggtgcttcctgcctgtggaggctatttatcccgcggccgtgtcaaactggaactcgactctagatctccatgggctggaaaatcagagcctagtcagagagaaccgaagcggggtcttttggactaccaactttccctcggtggtgtcctgccaggacggtctcaacgtgtcctggtttaaggccgcaactgccaccatatctcgagtgcacgggcggacattggagcagcacctgatccgtgaaatcacccccatcgtgacgcatcgagaggcaaaaatctcccggattaaaaaccggctctttaccctgctagagctacgcaatcggagtcagattcaagtgctgcacaagcgtttcctggaaggcctgctagactgcgcctccctcctgcgcctggatcccagctgtatcaaccgaatcgcctccgagggcctgtttgatttctccaagagaagcatcgcccactccaaaaaccgacacgagtgcgcgcttctgggtcacagacattcggcgaacgtgacaaagcttgttgtaaacgagcgcaagacccgcctggacatactgggccgtaacgctaactttttaacgaggtgtaagcatcaggttaatctaagacagtcacctattttcctgaccctcctgaggcacatccgccgacgtctgggcctgggccgtgcttccgtaaaacgagagattacccttctcctggcccacctgcgcaaaaagacagcccccatccaccgccgtgatgctcaagtgtaagcagcccggggcccgcttcattcacggggccgtgcacctgccatcgggacagattgtcttccacaccatccacagccccactcttgcctcggcgctgggactgcctggggaaaatgtacccatcccggccctcttccgtgcctcgggcctcaacgtccgtgagagcctacccatgaccaacatgagggcaccgatcatctcgctggctcgcctcatcctggcccccaacccctatatcctagagggacagctgacggtgggcatgacacaggacaacggcattcccgtgctttttgccaggcctgtcattgaggtaaaaagcgggcctgagtccaacattaaagcctcctcgcaacttatgatagcagaagactcctgcctgaatcagatcgcccccttttccgcatcagaacaccccgccttctccatggttgagtccgtaaaacgagtccgggtcgatgagggagcaaacacccggcgcaccatccgggatattctggagatccccgtgactgtgctctcatccctgcaactgtctcccaccaagtccatcctgaaaaagacaccggagcccccacctccggagccccaagccaccttcgatgccaccccctatgcccgcatcttttacgacatcgggcgacaggtgcccaagctgggcaatgcccccgccgcgcaggtcagcaacgtgctcatcgccaaccgctcccacaactctctaaggctggtgcccaatccggacttgctgcctctccagcatttgtacctcaagcacgtagtgctaaagagtctgaatctggagaatatagtgcaggactttgaggccatcttcacctcccagtctgataccatcagtgaggctgaaaccaaggcctttgagaagctggtagagcaagccaaaaacaccgtagagaacatagtcttttgcctcaacagcatctgttccacctctacactcccagatgtcgtccccgatgtcaataacccaaacattagcctggctctagagaagtattttctcatgttccctccctcaggcaccattatgagaaatgtcagattcgccacccccatcgtccggctcttgtgccaaggggctgagcttggcaccatggcacagtttctaggaaagtacatcaaggtcaagaaggaaaccggaatgtacacactggtcaagctttattacctgctgcgcatctaaaggaaaaacataacaatcttgtgaaccagaaagatacccagagcaaaagcaataaagtacaggattattgccaaaacaacgtgtgctctttcttcatacaggcccgcaatttccatgacagtcccgttggtggtcagcagcagatagtgaacgtggaggttgtcaaaatcaaagtagttggagctcaagatggagttttggacttcctgggaggtgatgtaggttgtagtttccaggccttccttttcatcataactgagcagggcaaagccacaaaaaatgcaggatttctgcgtcctggtaaaattctggatctttggaatctggcggggctccccagccacagcaccctgcgaacatttattcattataacgggggagagaaagagagagctgctgagataggtggtgctggcctcgtatagcgccgagcctcggacctcacggtcactagagattatgaatgtcacgttgatgagcgggataatcatcagaactttgtcgagcctgtccacgcatttgtaggcggggagatgccacgcatccctgtcttctcgctccaaagagagacgcccaagaaacccatccacagcatttgaaacggccgcctggtccagcattgcctcctggggggccatgctcagcagcttgtctcgtgtgaggtcaaatcgtaggctgaggtagcacggtgagaagagcccgctctccgtccccagggctagcccccgcaaaacctccccaatctctagggccgagcacagggcggtggacagcagttggtatagggcaaggttgggcccctgggtagtcacgttcagccgcaactcgcgtagcaccacgtggctgccgataaacagggtctctctcatcacggtatgcaggggctggaaaagggggtggcggttgtaggccgagagaagcacagatgtggcgcctccaatgaggccactgtaaaccccggccttggggtagccgacggtggctaacctcagcgcgtactcctgtttctcagtcgtcaggtgaccaagctcctccatcttgaccgtggccatcagcatggcggccaagcgctccagcccgtaggattgcatgcccttgaccgtggccccataacatatgccgatgatgtctttcaggacagtcagctcaaagaagctcttggccaaccagcggaggtccacgcagccattgccagtctcacccacggcatgacccaccttaaagaaggccacagaaacctcaaacatggtagtcagcgtttccgtgtccagttctggctcccggcagcctcccttcatctccagcaggaccagtttctggagaacgtagcgagcgtagctggcggctgtcatggtgacggctcgggaaaacatatccttcaggttgggtacaaagtagttgtgaaagttggcataatgcacaaaggttgtaacaatcaccagggaatagtccccgctttgggcactggttaaggatgggtaactaaaaggccccctcagatccggcaggtccttcgtcttgccaaagatcaggctcaacacatgctcatctcccttctcggtcactcgcttgtaggtgcccatcagaaatttagaagtcatggcccccgtgtactgaaacttgtccccgttgatggacagggccacataagacaagtgacagcgcagctgataaaagacatagctgtgtggccgcgtgttgggcagcatggtgccaatatagtagaagagctgcttctcaaggggggcactaagcatgcaggcaggggaattcaggccgctaatgactccgggatggaccttagatgcatccacttgcatggatccttcagagacagcagggatatcgacaggctcggccagcgcaataccaagggtaccagacgtcttgtaaattaacttgtagcggttaagcatagacgccaaatcttcggtgacatttgcctctctccacagcgcctctgggctaaggcctgggacctttgccatcagttcggtccatgggatggtgtaatgcgaagcatgcccctctatgtccaggtgcagcttaacctcgctaaggctggcagcccccacctcccatagcaacaccaggcaaaaaacacagagcaactgcatcctagtcccgatttcccctctcaaaatcagagatcaccttgctcagaccagcccaatcgaaaaactgagatcgtattgccggattcttcaatgcctgcatgtaaatctccgtccagcatccaggtaaatcgtcctgaaactctgagaggtccacaagcacaaactgaaggtaggctagcgttcgggtgaacgcaagacaaacttccaacaacaccgcgtcggctcggaaaggctgtatgacttccttaagtacactaaagatgctgttcttatacagcttctcggccacaccacttcgaattatgggggtgtggctttgatgacatactgtcgtgattgttgttagaccggcacataccttcacaatgtcctcgggggcaaaatactgtgttaggagccaggcacagtaaacggcgtgatatgcatcgttgacactcttcaggtagccagcatccagtcctgactcatgtttcctccctcgcttcttcaggcggcgcatgttctcctccacgtttaacttcatccagactatggtgtcccccgggtctgcggtaaacgtggccaaaacttgaataaagtcactataggagagaagctggctccggagcagcattagagggaaaaccacggaggccgacagcaaatggcgatcatgcaaaatccaacaatccaggggcgcgactgacctggcaccagactcggtaaccagcaagctccgcttcctagaggccaagactctgaaaggggtagtaaatttcatctggcatgctaaaacctcagccgacgtgtcttcccttccatgcctcgcccgagtcacattcttgtgcatggccttaatggcattttcatacacatgagtccagtaccgcatcggttcagggactacaatggtcaggtccccaaagacagccttcaaatgattcagcatagtagtctttcccacaccaggggcaccttccaaaaatagggaacaggcaggtttgattactggtacatgatttgtcaggtgggtcacaattggaacccgcgtgctctccttcctctgagccttggcctggcgggtgtcttgggcatcatccagattcagaacattcatcacactcccacttagccgcttcagctgggcagcatgcttggataacttactaaactcacgcccatgggcggccaggtgttcgaagagaccagaaggcttacccttgccaccattcttttgttttaacgcggaatgagaagagggcctgcggaaattagactcatcctcagactcacagtcagatttgtcatcgagcccaaggccagccaggccctcctcaaagcctttctggtacatgaagctccggctcgtggagtccgcacctccttctgtgcacgaagttttgcggaaccaggagaaggggtctggcgtcttgctggggccacactcccggctacggggcttcggggtaggggcagtaggcttttggtgtgcgggtgccggtggctgggctcccctgggtagggtaaaggggcacgatgtgtgccggctacccggagagtttccagtattagatgtcacggcagcctgggtccggcacggcaccctctccccagacagtccggtcggagccatcaaggggggccagtgggtgggcacctggtagagtccgtcatcatcttcctcacctgcccctgagtcactgccggttggggtaagaactgagggggcaaagtcatcaatctcagcgtaaaagttttcgtgtctttcgttttcaggggactcatcctcctgacattttcgccagccgccgggcgggccggcctcctttcctggaaatccagccatggatcccacccgaggtctgtgtgccctctccacgcacgacctggcaaaatttcacagtctccccccggctagaaaggcggcaggtaagcgagcgcaccttaggtgttactccaagctgctctctcttaagagctgggagcaactagcctcttttttgtctctgcccccgggacccacgtttacggactttagactatttttcgaagtcaccctgggtcggagaatcgcagattgcgttgtggtagctctgcagccttccccccggtgttatattgtagaatttaagacggccatgagcaacacggccaacccgcaaagcgttactcgcaaggcacagaggctagagggcaccgcccagttgtgtgactgtgccaattttcttcgcacgtcctgcccccccgtgctgggcagtcagggcctggaagtcttggcggcgttggtatttaaaaaccagcgatccctgagaacgctccaggtagagtttccagccctgggccaaaagaccctccccacctccaccaccggcctgctaaacctcctctcccgctggcaggatggcgctctccgggcacgtcttgatagaccccgcccgactgcccagggacacaggccccgaactcatgtgggccccaagccttcgcaactcactgcgcgtgtcccccgaagcgctcgagctggcagagcgggaggccgaaagggccaggtcggagcggtgggacaggtgtgcccaggtgctcaaaaataggctgctcggcgtggagctggacggcatcatgcgtgaccacctggccagggcggaggagatccgccaggacctggatgctgtagtggccttctctgatggcctggagagcatgcaggtcaggtccccctccacgggagggcgctctgcgccagccccgccctccccatccccagcccagccgttcactcggctcaccgggaacgcccagtatgcagtctcaatctctcccacggacccccctctgatggtggccggcagcctggctcaaacgctgcttggtaatctgtacgggaacatcaaccagtgggtaccgtccttcggaccctggtaccggaccatgtcggctaatgccatgcagcggcgcgtgttccctaagcagctgaggggcaacctgaactttaccaactccgtctccctaaagctgatgacagaagtggtggcggtgcttgagggcaccacccaggactttttctcagacgtcaggcacctgccagacctccaggctgccctgatcctctcggtggcctacctgctactccaggggggctcctcacaccagcagcgccccctccctgcctcacgggaagagctgctggagctgggcccggagagcctagagaaaatcatcgctgacctcaaggccaagtcacccggcggaaattttatgattttaacaagcggaaacaaggaagcgcgccagtcaatagcccctctcaaccgacaggcggcatatccacccggcacattcgcggacaataagatttacaacctgtttgtgggagcgggactactgcccacgacggccgcgctgaacgtgcccggggcggcgggtcgggaccgggacctggtgtaccggatcgccaaccagatctttggggaggatgtgccccccttctcatctcaccagtggaacctgcgcgtaggtttagccgcactcgaggccctgatgctcgtctacacgctctgcgagaccgccaacctggccgaggcggccacccggcgtctacacctatcgtccctgctcccccaggcgatgcagcggcgcaagcctgccgtggcgtcagctggcatgccgggcgcctatccagtccagacgcttttccgccatggggagctcttccgcttcatctgggcccactacgtgaggcccacggtggcggcagacccccaggcctccatcagctctcttttccccgggctggttttgctggccctggagctgaagttgatggatgggcaggctccctcccattatgccataaacctgaccggacaaaagtttgacaccctctttgagattatcaaccagaagcttttatttcacgacccggctgccatgctggcggcgcgcacacagctgcgtctagccttcgaggacggcgtcggtgttgccctggggcggccctcgcccacgcttgcggcgcgggagatcctggagcgtcaattctccgcctcggatgactacgaccggttgtacttcctgacgctgggctacctggcctcccctgtggccccaagctgagccagttcctcgcactggagtgggtcattggcaaagaggtaaataaagtcatcgcacgggggttttgcctccttctcgtctcttgtttcgggtaggggagtaaggccgtgccaggccgccatgctcagggccacggcgtgccagaggccctcgtagtcgtgcgcatccgagaggatggcacggtccagaagcagatagccggccaggcagaggaaggccacaaagagggggcgaaggcgggcccgaacccgggtttcatgctcatctgccccccagtgaacaaggcagtagaggacacccaccaccaggcggttagggaggacactgccaaggttgaagagcagatttccgtcagccagggtgacctggctcaggtccggcgccctgcgcagtccaagctgcgcccacacacatgcacagacggcccctgtgacatcaggccggtcatgcaaaaacagacaaagagaccgtgagcggttaccggggcgcagggcctctgccgggaagcccacccgtgccagggcccggtaaagcaggtaccagtattcatccggcaccttgcgtgccaacacacgattcgtgcggtttccagtatttatcacggcttcccgccacaggtaaaagttaacacttagggtcagcagcttggtcagggataggtgcaaaaacctgagctcgtcctcgcgcagagcgcaaagcggccagttctttagcatcttcaggaggagcccgtgaatcccaggtgtcattcgcgcgtcatccccgcgaacccccagtcccattaacatagcgggcacaatggtgcaggcaccgtctgtatacgtctgcggcttcgtggagcgcccggacgccccacccaaggacgcctgccttcacctggatcccctcaccgtcaagagccagctccctctgaagaagcccttgccactcacggtggaacacctgccggatgctccggtcggctcagtctttggcctttaccagagccgagcgggtctctttagcgcagcctcgattacctctggggacttcctgtccctgctggactcaatttaccacgattgcgatattgcacagagtcagcgcctgcccctccctcgagaacccaaggtggaggctctgcacgcctggctcccctcactgtcactggcctccctccacccagacataccccaaaccaccgcagatggaggcaagctgtccttctttgaccatgtgtctatctgtgccctgggtcgccggcgcggcaccacggcagtctacggtacagaccttgcgtgggtcctgaagcactttagtgacctggaaccgtctatcgccgcccagattgagaatgacgccaatgctgcaaagcgtgaatccggatgcccggaagaccaccctctgcccctcacgaagctcatagctaaggcaatcgatgctggatttctgagaaaccgcgtggagactctgaggcaggacaggggtgtggccaatatcccagccgagtcgtatttaaaggccagcgacgccccggacctacaaaagccggacaaggcacttcagagcccaccaccggcctccacagacccagccaccatgctatcaggtaacgcaggagaaggagcaacagcctgcggaggttcggccgccgcgggccaggacctcatcagcgtcccccgcaacacctttatgacactgcttcagaccaacctggacaacaaaccgccgaggcaaaccccgctaccctacgcggccccgctgccccccttttcccaccaggcaatagccaccgcgccttcctacggtcctggggccggagcggtctccccggccggcggctactttacctccccaggaggttactacgccgggcccgcgggcggggacccgggtgccttcttggcgatggacgctcacacctaccacccccacccacacccccctccggcctactttggcttgccgggcctctttggcccccctccacccgtgcctccttactacggatcccacttgcgggcagactacgtccccgctccctcgcgatccaacaagcggaaaagagaccccgaggaggatgaagaaggcgggggactattcccgggggaggacgccaccctctaccgcaaggacatagcgggcctctccaagagtgtgaatgagttacagcacacgctacaggccctgcgccgggagacgctgtcctacggccacaccggagtcggatactgcccccagcagggcccctgctacacccactcggggccttacggatttcagcctcatcaaagctacgaagtgcccagatacgtccctcatccacccccaccaccaacttctcaccaggcagctcaggcgcagcctccacccccgggcacacaggcccccgaagcccactgtgtggccgagtccacgatccctgaggcgggagcagccgggaactctggaccccgggaggacaccaaccctcagcagcccaccaccgagggccacccccgcggaaagaaactggtgcaggcctctgcatccggagtggctcagtctaaggagcccaccacccccaaggccaagtctgtgtcagcccacctcaagtccatcttttgcgaggaattgctgaataaacgcgtggcttgaaagtaaactttattgcgtgttagtaactgtccattcacaggggtatccagcccttgcgccgcctcccccagcccgccagccaccccagacaggagatgataatgatgaggagcaccggagccaccacagcacaagtgattaggagcagggcccagtgcacccaggtggtcttagggcgccagggatcgattggaaaagggcccagggtcactggcttatgcgtgggacgtttagaaacaggccgcctatggggcctgtgactggtgcttgtggtgtgggagactaatgtggtgggggctatggtagtggctgggataacagtaagatgcatacgctgagtgagcgtccggttggcatggtattggtcgtcttcttcccctgcagagtaattgcagtggaccccggaggccacactgcaatttctcagtgtcacattgcacgtgtagtaacctgcatgcgcaagggtcacattggggattatcagagagacggaggtgttggagtcatttacccattctagggtaaggctataattgtaacccccgttagttatatgagttccgttgttggaagtagctacggccaagggcagttgtccatccccgggagtgtatccccggcccaactcgatccgagagaccgactcattgctaggaacgctgcaggtgagattcactctagcacctgcatgggcggtgacattttcaaatttaaccagatctgagaaaaatgcacaaacagaccccacacagcagcacaatagaagcactaaatgagtcattcctaaactgtcagttttaaaactccctgcttctcaggcctaaatacgtggtggggtgtgcttaggatcactttcatattctgcaacaacagccatacccggaagaggagctgccggttgccatttttcaagctgctaaaccacgagtggcagcaggcctaagaagctcctcagcaacatggagacctcgaagggaaactggcaggagcagggagtcacgtaggcactagcctcttcatgtgaggtaagagatcgctaaaaatgggatcagggtatgtaaaccgagttttgcgggggatggtgagccagacacggcgggtggggggaaggagctgacacgagtgcgtagaaagggccaaaaatacaccagctataaggaattgctcaggccaaagttgttcctcaggtggctttaggcctaatgtaggcaattgcgtgcctagaacattgctaatgtgccctgtgtttcctgccttcatgcaaatatcctacctcccccggcctggtgcaaaatgtctgcctcagaatactaacagctaatccaagctaacattctatcagtaaacgggcagaaaacggataaggaccgcggagtttggccctccgcggtgtccggtggtcctcacacgtgccccccccgggccgatggctgaggcccggaatatgcaagtgcatctttctaaccagtaggggcctccacctaggtgctttgttaatctttagtgggaactagtgggagtgctgtgcctagggtacccctatcctagaggtcctaccggagctccttgtcttgataatccctgtaaacacacaccacctaagaacaaggcatcgttaacctttggtggaacctagtgttagtgttgtgctgtaaataagtgtccagcgcaccactagtcaccaggtgtcaccggaggctacttgcctcagtgccacttttaccttctcaaatctatacgggggggggctctgtaacatttggtgggacctgatgctgctggtgtgctgtaaataagtgcctagcacatcacgtaggcaccaggtgtcaccagggctacttgcctcggcatctcctcaccggagaaggggttaacaaacccgtggggggtcttagtggaagtgacgtgctgtgaatacaggtccatagcaccgctatccactatgtctcgcccgggctatatgtcgccttacctcccctgtatagtcacgaccccaccgaaccaggcatgatgtagaataaaattttatgcatcgtcttctaatctgtgccgcttggagggaaacatgaccacctgaagtctgttaaccaggtcagtggttttgtttccttgatagagacacaaggactgccagccccgttggggagggggtggtgggtacgggagaatttgggctcgtttaaacaaagcctcctctgatgctctgtggcacctcaaggtgaatatagctgcccatcgacgtatcgctggaaaccggtgggccgctgttcacctaaagtgacgcaaggtctgtcagccgccagggtccgtttaccaggctttcaggtgtggaatttagatagagtgggtgtgtgctcttgtttaattacaccaagatcaccaccctctatccatatcccacaattgataaacctccgcatgtccaaccaccacgttgaacaggatgtggcaccctaagaggacgcaggcatacaaggttattacctagtccttgtatgcctggtgtccccttagtgggacgcaggcctaggtagcatcatttacactaaaagcagtgaccttgttggtactttaaggttggtccaatccataggcttttgtgaaaacccggggatcggactagccttagagtaactcaaggccaagcatttcacacctgcaaatgcaccatgtaaccacagatctaaactgaaagttgcagctttagatggcaaggaaacttgggtttcaggcatagaaagcctggctcactatagcagcccatgtttgttccagggtgggggaaaggcacatgcccttagaaaacttagctgcaaaaattctattgtgttgggagagcctccatatctaaaggcctttcctcacaatacaaatgttactaacgtctgccctctggagacctgctatgtggctagacgtatggcctacccaagacgttgggggtctcgggtaggccatgattcttccaggcataggttacaaccagtcactgctatcaagcctactcagttcccaacgcagcacataccccccgcctctcctgccatgaggacttatggcagtgtttactgttctgcttttactcttggaccaggctgtcattctatcagaataacaggggaagcaaggccccctgcgtcagcgggacacgtgtttctagaatctcggagccaataactacctgcccctctaatctgtatgctgcatgaaaaaccacatacacgtgatgtaagtttagccagtttattgttacaccaatgccccgaaagtctccccctgtcgctttgggtctcaggacccagccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccggggttccggccctggagctcggggggcggccgggtggcccaccgggtccgctgggtccgctgccccgctgcggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgggtccgctgccccgctccggcggggggtggccggctgcagccgggtccggggttccggccctggagctcggggggcggccgggtggcccaccgggtccgctgccccgctccggcggggatgggggtgcgctcccaggccggaccctggtgccaggcagggaccccgcgccacccgcttcatggggggggaggccgccgcaaggacgccgggccggctgggaggtgtgcaccccccgagcgtctggacgacgctggcgagccgggccggctcgccttcttttatcctctttttggggtctctgtgtaatactttaaggtttgctcaggagtgggggcttcttattggttaattcaggtgtgtcattttagcccgttgggtttcattaaggtgtgtcaccaggtgggtggtacctggaggtcattctattgggataacgagaggaggaggggctagaggtccgcgagatttggggtaggcggagcctcaggagggtcccctccatagggttgaaccaggagggggaggattgggctccgccccgatatacctagtgggtggagcctagaggtaggtatccatagggttccatgatcctggaggtatcctaagctccgcccctatataccaggtgggtggagctaggtaggattcagctaggttcctactggggtacccccctaccctaccttaaggtgcgccacccttcctccttccgttttaatggtagaataacctataggttattaacctagtggtggaatagggtattgcagctgggtatatacctataggtatatagaacctagaggaagggaaccctatagtgtaatccctcccccccctacccccccctcccttacggttgcctgagcccatcccccaccccagcaccccggggtgacgtggccccccgcgtgccttcctgacttgtcacctttgcacatttggtcagctgaccgatgctcgccacttcctgggtcatgacctggcctgtgccttgtcccgtggacaatgtccctccagcgtggtggctgcctttgggatgcatcactttgagccactaagcccccgttgctcgccttgcctgcctcaccatgacacactaagcccctgctaatccatgagccccgcctttaggaagcaccacgtcccggggacggaagctggattttggccagtcttcaattttggggagtggttttgtgtgagccggaagttggcaatggggtgagggcggcgctggttaagctgacgacctcccaaggtctctcaccctgggtacacaggtggggcggcagcctctaactttggctgtggcctctatttcctccctttcctagccagggccatgtgttcctgcatgtctacttgcctcctgtggtggcagagcttggccctgggcccaacccccgccttgggagcctgtaggggccaacacccttggtttgtttgtgttcctgtttgctggcaacttactggcagccgagcagattctaatgggcgcccgccttctttctctcttgttttattaatagaatctcagccaggacctatacctgagacttcaaagtctggtcctgggttctgagacccccaagatttgtcatgcacacctgcacacctgttggtattgggtttctattcttgagtgtgaaagtttgtaaaaaaattcataaaatgtcactaattcctcttacctgtttagggtattgtgcaattcttcagcctgcctattttcaatttgcctaaggtggcaatttaagatgtggttaattaaccattttcctgtctgacaccactgcatgggcaaccgggttccatggcacatttagagataaacatagatgtcttgtcttgctcatgtgcagaggagggggtgttggtgtgcaatatagtttctggattccaaattgagttgggggtgctattttcactatggaattaaattactgacattagacagtggacaccgggctatatgtggggatgtctgtggcttgtcatttcctcttagaaggtaatcccccatcttaacttccctttaaattgtgatgcaagccctgggttatttatagaatgattatctaggtttgatagtctgaaggctgggcagagaatgtttgtaatttttattcaccttctttaccccccacgagtatccagttctagaagatctcctgatatcccgggctgccattattcccttgagtgttatagcttcctcttaacttaagcaagagctccaggatgttagcttttttggtggggctggttgtcaggaagaggttccagtgttgtcctttatttttagatgttagctttgtgttgggttagtatgggctgggtattcactagtgaaggcaactaacacagttagacgtgctagttgtgcccactggtgtttatccggtcccaaatgtcaccacagaacacaggaggctggatttggcagcagcacttgtgcttttgttgatttttacccgtgtatcagagttgggggatgctagccaatttagcttcccctccccttaacagggggtctcgcggggtgccaattgtcgcctgccttcccctgcttccccttgttaacttatagcatgataggtaggtcacccaacgtggaagcctggtgggtgatccttcctcggtagggagcgcttagggctgttgagctcaagagccccacctgggtaaaatgtatgttctaaagagttacccaattataacaaaaatgttgtagggtaacgaagacctaatggaagtggtattgttgccgttgaaagacgggtgtcctggctcaagttcgcacttcctatacagtgttaaagccttgtatcggaagtttgggcttcgtcccagtgtactcgataatgtcgactgctgcgaaggtttgggccgtcttccagtaggtgttgggggtccccaatcatgaggttaggcaggtgcacttagctctttagggacccttaagccagacaatgtagtgcccctttttttgcaaattggccttattattaatttcttgttaacactaattctgttctatgaccccgtgtttttcagatgccattgggcgtgtcactgagctgaatttggacgcagctacttgacctttgcccccgtgcctccagcgctgataagtgctgcgtccactttgtgttacaggtgggccaaacctccagaatatcaattggtggggccttggtgggctgcataaggcagtaggtttgaggtgacctacttggaccatgtggatccagtgtcctgatcctggaccttgactatgaaacaattctaaaaaaatgcatcatagtccagtgtccagggacagtgcactcggaagtctcatcatctccgtttgtgtgtttagtgtggccagtacggccactcctgtgccacgccctggcatgctgctgacatctgggcgccaatttcagcgggcccttttcccccttgtttaccccatagcaagaagggtaggttacatgggtattttcccatcagcacctgactggccggtgtaattagaggagagggcaacaacgcaaggctgttgttttatttgggttacaagacctgcggcggtcaatgggtttactgattacggtttcctagattgtacagatgaactagaactgtcacaatctatggggtcgtagacagtgtgcttaccagacttccatggaagatgtgaatttgctgctagctatatgggtggcgctatgggctccctagggactcatgtagtggggctttgtgatagctaatgaatgtggcagctgttgtttgtactggaccctgaattggaaacagtaacttggattctgtaacacttcatgggtcccgtagtgacaactatgctgaatatcttgaatatgggaggagggggggctttgggtttcattgtgtgccctttcctgtccaacgtgagggttctagtgttatagggcgtggcagtgtttcttgagggctaatatcacgggtgaggcggttgtcacaggtgctagaccctggagttgaaccagtaccactcggttacaaagtcatggtctagtagttgtgaccctgcaaagctacgtggggatgagcagccagggactttggttgacaagcagacaggcggcgcattggaaccccagaggaatgtcccggggccacctctttggttctgtacatattttgttattgtacataaccatggagttggctgtggtgcactccatctggtaaggggggctggtgcggacgcctgtgtttagtctatgccaatgtttacctgccttgggttactattccaaacgaccacacctttaaggacacctggagccctgatcattctcggcttttactgccacctggcttctgttgggtcagacagtttggtgcgctagttgtgtgcttagcagcaacgcacaccaggctgactgccttagcagtgtggtcctttattgtggcatcctaaggagggattctggagtgcctttcacgtgaagcatgccctgagacgtactcgaggcagtactttaatcgctcatgtgccgctagatgagggagcgccaatttgtacatcctagctctggccatagagttagcccacccttgtgtctccctttggcctctgcggtgccaatttccggtggtttcccttttccgcccgtttatccaatagcatgtaagagaggtttcctagatttggcaactttgagggaacgttccgcgtagctggtgacctaagacccgcccatcaccaccggacagattctgaacttgtcctgtggtgtttggtgtggttttggggtacgcaggagtacgttggaatgctttggagccgagagggatgggcccgcttgtgcgcttatgtgttacacggtgccaataaccggcctggtgcggctgccccgtgacccgtgggccttaccttcctggccatcgggggaccctggtgctagggtcccttgtgttgctttctgccataggggggaaagcatcgccttcagaattggctgctccgttggaacatttgaggcctactgtatccgtgtcctgacaacattccccgcaaacacgacatgggttaatttaaacatgttttgtttgcttgggaatgctcttagggcccggaagcttgtcattggattcatcgtttcctgaactacaggcgtagggcctattgtagcaggcatgtcttcattcctgcgtaccgaatggcatgaaggcacagcctgttaccattggcaccttttttccatgtaaacctccgtgatcccgggtcctttggagactcaagtgtgaatttgttttggtgttcggcgccagggcatcttgacgttggaatgtcaactcaacttgggcacctcgataaccggctcgtggctcgtacagacgattgtttggctctgtaacttgccagggacggctgacgatgtgtttagtctgccacttgcatccggcgctttggttacacgggagactaatggggggtgtggtatggcacaggctgggggtgagtctggggatgtccctgggcgttgctgcagcccattcgccctctggggatgagatgttcaggggtggccggtaccctacgctgccgatttacataatataaattgtaaatgctgcagtagtagggatctggacgcgcgacctgctactcttcggaaacgccaacccaggagcgtcgcctctggccccatactcccgccatgcgactgctcgccccctcccaggcctccctggtgagcccttgccgctccccgcattcctgctttcggcgcccctgcggaccccgatgacagcaggccttcccttcccccgttaatgaaaagaatgacagagaggttgtgacagaaggacagctttattcagtttacagagtgccctcggaggctacgatattcccgttaaatgtcttgttgattctctcaaaggtggggagggaggagctctccacaacaatgttccctggcagcgtgagcgcgcagccctgccgttggatgtatcttctcatgatggtgctgatagaggggtctccggcgtagatgaaaaaggcctgggccatgctctggccggtcacgatcgttatggggttgttggaaatgttccggaccgtcagcttgagggtctggcccggcttccactcctgtgggtagacgtagaagaccgggttggaggagtgggacacgacaacggccgtaatcttggagctcaggggggcctcgtaggtgttgttgtattccagctccgtgatgaaattaggaggaataatcacaggggagccaaagtagcggatgtctgtggattccccgtcccagcgccagtggctcttagggtaggggttgtaatggaaggcaataatcacatcatccaatagggtcatgcccaccttgacgttcagcgggccctctcgtttcaggtccggcgtgtccacggagactcggacgtagcccttaccgcggcgtatggcgttgaccggacacaccttccccgggaatgtgtgaatacgggcgtatgactttagaaatgggggcgtgtgctgcgccagcaggtaaggcaggcactcgtcctggctggtgacgggagagccactgaggaagatctggggctcgctggtgtttagcttgtccccactctgggtgcaggagcgtgtcagctgaatgtcgctctgcccgggcagaatctgcaggtagaggtaggggttcttgaccaatctgatgggcacaatgtaccaggtaaacttccctttctctatgaacaggctgcgcggattcaggacgcttagcacgatgtcctggtcagagtgcataacgaagaagggcttgaggaatacctcgttgtcttccgctccaaagaacaagaacgcaaccgtaaagtagcggctgccgtaggtggtcgtgttgaaggagaaagaaggtaacttgaagctgagtatctggcccaccgaggggcagggaggcagctcttggcactgcgcgtccagctgcaatacctgcttgttggtgacgcgaacgtatgaggggaagatctcgtacttccacacgcctctcatgaacgacgtgtctggtttttcagtgggccgcaggcggcggaggctgttcctgaacgacgagcgccgggacgctagtgctgcatgggctcctccggggtaagcttcggccatggccggagctcgtcgacgggcaaggtgagagttggggggcgggcgacggtgcggccccaatacaactctccgctcgttagctggtagaatatccgcccggcgtctaggttgtcacttcgctcggccggccagaagagcgcaagtccaagtctggtgctggggccgatgtgcagcggtttgtgcccgcagttgtagactgtcatttttatgggcgagtgggcggtccacacgcgcgggcgcagcacccattggtcgcacgccgcctcctggaatgtaaacccccagagagagggcgtgccgccctggagatggccctgtgccatcacatgtatttcctccttgggtggaacgacggcgtcgtgctccgggtggagggggaatagcgtccaggcatctttcagggtcacgagaccggggtccatgcttagaaaacagccctcccgggcggtgggcggcccgggctccagcagaacgtcgcagacccagccctcctcggccctgtccacctgtatgtccaggtgcacggacccggaggctgcgtctcgtgacatggccaggcctggtgccagccgaccacgtcccgtgtcccagccgaggccacgccagagcagagcccgggactgactcagggccacatcccctcggcccgcggacgccgcctcgccagcccccgggccttcatgggcccgctttctacctctctccggcaccccagcctggtcagccgcagaggaagcatgaccttggggtgggacggggcaggcgtgatcctgggcgcaatctttgccgatccccacaccttcactccttgttaggttgatagaatgtcggtaccacgccacggggggcgggcccgcatagggaaaagccagggagagcgatgtgggcgaggatgggctcaggcggccccagacacgcaatttgcccccctgggcggccgcagcctgcccctcggcggcccgtgccccagctccgtcacggggggcgcataggaggggtatatctaggatagccgcacctacacaaatgagacacagacacaggtcatgaggatttaggcaacgcaggcttgtctttatagttacaaacatgggagcgtgcacctggaagatgcagctggggtagatctttacatctttacagggcgcagcagccgccagacactgaagggcagagttcacggcgggcacctcccagagggagcccaccagcccgtacctggccacggccagggcctcgtaggccgagacgggcagccggagcttgtggtactgtccctccggcaggtggagtgggacacagttagagaacattagtcctctggtccctatctccacccgccaggcctgtgtgtcagtttgcagggccatcctcgcgctcaggtggactggctaggcacccttctgaagtatctggcggtgactgtcacctggttcttgagagagtccataaaatggctgaagctccaggcgtatagtataatgagcaacagggccaaacaggcggcggggcctgggtagtagcgggcaacgagagactctgtgcaatcaaaccccaggctcccggcctcacccaggaagagcagcggcagggacagcataaaccaggagaaggcgcaaatgagtccggtgaaggtgacgttgcatatcaggcgcggcttccttccgaattttgtgcgcaaaagtttccagatgatgataactgtgaggaggacgatcaggactgccgccagtaggtagcagccggctttcagtccttggacggccgtgtgcatgcctttggtggggccttccctgcacatgttggggcctctgttgagattggcgtcggggcccatggtaatgaggaggatgataatcagcaggagtaccagacaaaacacgcccatcaggtacaggcacacatttctgtgggaggttctcttgggcgttcggctgaacaatgctagggtcttctccaacgccatacccaagtgagtccatacggagcacatcaggcccaagaacatcatgttctgggtcaaaaggcagagaccggtagacgagaactcctgaatcatttttcccagcacccagagcagcagttctatgagaagagctatcagccagacatccattcggtgaaccaattttcttacaaagatgataaacaagatgccagccagtgttagcagaatcagcaggacgagcagcaggcttgtcatgccgctgaggaaggcgctgtaggatttagtgcacgcatcttccgttgcattgacggaagtcatgttggccaccagggtccccacggtggacccgggggccatggtggagagcatcttgctggtcagagccagactgggtggtgtctgcagcaaaagaggaacttgcccaggcagtcagttattttgcatgccacctccctgcctggtggacttccagactattttctgcattcgcccttgcgtgtccattgttgcaaggagcgatttggagaaaataaactgtgagtttcacagatccacgggccacgctcccctgggggcttcatgatcccaccgcctttcccgatgatgatgacaaccgcggctgtctgaagcggctgacgaaatcggttgagattctgatgagaggcttggggggtctttgccctcaaggtgaggctccttctaggaatgccgagccccctgcactagcttcgctccgctggggatctttgccagccttcatactagattcagcgatcccccggttgggaatcttcgccagcccccccgtcctgctatcctgctcgtcgccgcgcctcccatgctaagggcccccttcctttcccttgactttggggatattcggagtctgctctcgccgctctcttctctcgtttaaacgagagaatagtagtagggtccagtctcaggccccctcactttgggtcttagaatggtggccgggctgtaaaattctggaggacggagagggcggccccggagttgttatcaaagaggcactggaggatgttggccgctccttggagcagcttgtcgaaataatgatccacggccacgggaacgccgtgccgctcggcgtaggccgggtcctcggccatctccgtctttctcgcccccttcactccccccttgggctccacaaagacgtactggatgcggtcgtggatctggggcagttcctcgttgcgctcgacgaacttctggtagacggccaggtgaggcatctgggtgctcttgtaggctgagagcttgcggctgagctccgttgaaaagcagagctcccccatggggaccctgccttcacggaggtctgtgtaggcctggtttaggatgtcaatgacgggcaaaaagcccacaggtagcccttgtgtaaatgactcttggaagggccggtgggagaggaggctggccgcctcctttacccgggcatccgccagcaccaggtcgagcacgcgccggcagcgtgtctgcacaaacttgcaggccgtcttccggacgagctccacccccttcatcagggtcttgccgtccgtcagcacccccacatatctcttctttgtaatcagcatcaggcaggagaaggtcttctcggcctccagggagatgggggccacaaacaggctccgggtggtgtgggcggccagggcctcggcaaagcgcagggtctcgctctctgaaaacccccggcactcgataaacagcgagtccgtgtccccgtagatgactcgaagctggccctcggggttgaggggcgcccaggcgtctggggacggggccagggcctgcaggttggcggggctcagggcctccacgaaggccttggcccgctccaacatcgtgcggccctgcagcgtcaccgtctcggcgatggagaggcagggaaagaggccgttggccaccccggtgaagccgtagacggcgttgcacgtgcacttgatggccagctgctgcttgtcgaggatggtcctttggcgcggatcctcgcaggccgccagcagcttcttgatggccttgcgcttggccagccaggaggtcaacagactagccaagaaggactcgtgcacgtgcttctttacaaagtggtagacgccccccgtgagcctgaaggactcatagtcttctcccgggcgcaggccggctagcctgtgctcttctcccggcgttatcatggtagaataacagagattatgagcctgaatgatgctcgggtagaggctggcaaagtccaccaccagaaccggggagttgtagaatccggacaggggctggatgacggtggccccctggtagccgtcccggtcagaggccgagggcatgggcaggataaagttttccttttgggcggccgccaggaggcaggagaacacgcggatctgctgcccatcgtccagcacccgcctgcaggggatgtgagcgatcttggcaatctctgccacctccacgtggatcacgaaatggtttagcagatccatgaccagggccgagtcctgcacgcagtacatgccgagccgcctgcgcccctcggggcccgctgcaaagaggcgaggaatctccttgtaatgcacatcctccttcttggcccccagtaggtgcctggctactgtgtccagcttgtagtctgagaggctgagcttgtcccggcacacggcgtacatgtcgatggggatgaggccggtgatgcggaccttggtgttggcccgcaagaagcccttgcccgcatcatggggtcgcctgacctcgcagacgcccccagccctaattttgcccagagaggctgggttgatgctgtagatgtgcctggctctgtccagaatgtagggccagtcaaagttggccacgttgtagccggtcacaatctccacgctgaggtctctgatgagctggaagaaggcgtagagcatgtccagctccgatgggaactcgtagacctcaaccccctctatgtcttcgcaggtgcccagcgtcagcaggatgcgcctatagcgcccggcctcctcccctgtcgaccagaggacgcaggatatctgcaggatcaggtcagcctcgttggtggccgtggggaagccctcctcccccaaacactcgatatcgaaggccagggcctggtaggagggccaggagctgtcttcacgccggaccgagaggtcgcccacctcacagtcgtactcgagctcggcgtacgagtcccggtgctggaggcgggggatggcgcggcggcagctgtaccagccaaaggtgacaaagtcattgtccaggacaaagcggcgcgtggcatccacgttggcctcaaagatctgacacccgtgcttgtcttgcagccacgtggccacgtgacacacactgttgggatgggagagggtgatcttgtggtagtcgccggcatggttgccgtagcccataatggaacggcgcgtgaccttctccaccgagacccggcagggggtcctgcggtcgaaggtgctggccttgagggcgctgaggactgcaaactccacgtccagaccctgaggcgcgctggcgtagaagtaggcctgctgcccaaacacgttcacacacacgctggccccatcggccttgcgccggcccagtagcttgatgacgatgccgcatggcaccacatacccctgtttatccgatggaatgacggcgcatttctcgtgcgtgtacaccgtctcaagtatgtcgtagacatggaagtctagagggcttccgtgggtgtctgcctccggccttgccgtgccctcttgggcacgctggcgccaccacatgccctttccatcctcgtcaccccccaccaccgtcagggagtcttggtagaaacacagggggggctgaggccctcgcacatccaccacccctgcggcgcctggggtctggaaacacttgggaatgagacgcaggtactccttgtcaggctttttcagaaggcctttattaggtcttaggaaagggttatagaagagtcccccagacatggttaaaactcagtctctgcctccccaagcagtgcggcggcggtctctggatcgtgatagcgtcttctgcgtaggcctggaaaacggtccctggctgcctgcaatgctctgctggccactgagggtccggccgccctctgagctgctctcttttgctcctggttttgctcatgcagcgctaacatgatggcttgtaattctgtcttactaatgggattaatgcctggaccctcaccagaggcatgttgctgagcgagctcgtcgatcccggggtagagcatctgcaccggctgctgcgacatctggcgcgtgcgcctcgtgagggaaataaccaggatcaccacccccaccaccaggaccagaatgagcatgccgccgaaggggtttttgaagaaggagatgaaacccgagaccaggctgctaaacaaaccccccaccgtgctgactaggttggtgatggactgacccacgctacccagactgtccataagttcccccaggccgtccacaaattgatttctgccgtttgacactgcattgtccaaatccttccgcaggccggcgatgttttgcgcctggaagttgtactcccggaagatgccctccaggtcaaagacgttggaggcacgctgttcgtcccgtgagtacagctccagggaggcaaagtcaatgttctcgatgagggaggtgtttagtgagatgaaggtctgcagggtggcaatgccgtccagctcgatggttttaaagtggtggtagtcgttgtagacgtggatctcgttgccggactggaagtagtactggctggtcgcctggcacacctccgtcatcttttttgtaaggaagatctcgttgtcggtgcccagctgtccctcgtaggtcttggtgtcgttgataaagctgaaggacaccagggggcgcgagtagcacatggtctcggagccggggaccctcatgctcttgcgcagggtgacggtggcctggttaacgggcacgcactgggagactgagatgacatcccccaggcgcttggccgccaccgccttaccgtagatgctggacatgacggtggtgggattaatcttggttagttctctcagcaccatgttctgcctcttctgctccaggcaccaggcccgcgcaaggtctcccagcatgcggttgatctggcggcgcagggagtcgtaggcaaattggatctggacggtggcgggattgttgagggtgcccagggacttcccgggggccgcggggggcaccggtgtggtggcattccccgcattccgcctccggcgcctcagaacggcggcggaggtgctcccgcgggccgcgggtggggcggggggcgatggactgctggggggtgaggaagtcggagtggtaagctccgtcaggttcttgacggtggccaacgagcgcggggtcagaggtagccaagctaataacaatcctccgctcgttataaaatatgtaatggcttcctggcccttcgtgtaacgatcctggacggcctcgtacttttcatgcatggtcttgttcacctgctcttcgatgcacttgaaggcgtccgggagctctatgcccacggttgtgttggtcacgaagctagaggtgccctcgtcagtcacaaaatgtattgacttccctgtttctgtggcgatggtcgagtcaaaggtttgccagtgttgaagcgggcagtaggctgtcctgttctcgagcttccaagatagcgtgtaagtgcccttgtccaggaaggctcggcgttcgccttgcgggttcgtccctcggttgtcgtagtccactatcttgtagttagttctcacgtggaaggagtctgcccgctcatggaaggtttccgtatttttcccgtcatagaaaggggacatttccacagtctgcccggtggtggtcacaaagaagtcgaaggggctgttggacttggccatcatgtcagttatcaggcagttgacggtagttcttgttctgtaagtccatatcaaccacccgggggcgtcatagagctccgtctggctggcgtagcggcgcaccccgttggccaggcccccggtgggctttaggttgacggtgatgttaactccgtcgcggtctacatacacgcgcgtcagcccatcttttgtcatctttaccgcgttgtagcactggtagatggtatccatctggtcagtttcgtagctctcaacggagaacttctcctcgtgccggttggtcacggagtccgcgtaccagccattgtagatgagaatgttggtcactatcttggtgtaggagcggaccttaaacgagtagggaataatgttgtctttaaacaccatcaacaggccctccgtgtgattctcccgcgtgccaaacgagggacactggatgtccgaggagaagcggaacaggtcgccgtggctggagagctcgcagactcggaaaggaaagctggtttgctgacgcgtggcggtaggctgcaccgtggtggcggggggcgcgggctgctctggggtctgcgcaccgaggcggcacgccagggcggctagcagcacgaccacgcttagcaccctacgccgagtcatctctcatttggaggtgcaggtagagaagggcatatagatccttaaatacccaccccctgcccttatacagaagaattaggggccggtcagagtcgtacgtgaggtaaagcccatccgggggcagggcctggccggggctgaccgcgtccgcccggcgcaggatcaaggaccgcccccaggtcttgttgtagagggacacggttaggacggcctcgcgcagcgcccggcacagaatttgctggctagatgccagtgagcccccgggtacgctgtagaagctgttgaaggaggtctctatccagtcgctcggctcgatgcctggccatatcagggaagtcaggaacgccttctggtgaggcagcgtacctgcggcgtcacagcagcgagccagggccacgttgctgggtgggggaaagagcccgctctcctccgccaggggccccgtgatgaaggtgtacaggctgtgcgtcagcgcgtgcaggtgctccgagctcagggtctgggtaaacaggtgtgttttgatgtacttggaattctcaaaggcggcaccctcgccggcgcgcctgtcctcccagggacccgagacgaaggcccgtctgtagaggaagtggttgcgcatgcgggccagctcccagtagaccacgtccccccagacgcgcaggcacagggtctcggtcagggtctcgctctgttgcgccaggcaggactgcagcttggccagaccctcggtggccacctggcgcaggtactgctccttgcgcttgagcgcgtccgagagggcgccggacgggccgggctctcgtgccccagccggccggggcacctccgggctctcccgggacgcctcctcctcgcctcggcccaaccgctgcatggctcggttgagccgcgtgtagagctcgttcctcttttgcaggatggcccggtactgggggtgcgccgtgaaggcggcggcgcagtccgccttcagcgcctccaccgcgtcgcccgaggagctgtagaccccgccgcagaagagccgctctgtggccccgggagccacggcatcaaacaggtgagtcagccttgcccccgccagcgcctcctcgcaggcccgccgcaccagggccaggcgacgctcccgggcaaacagggcagagaggcgggaatgtccgccaccctccccctgccccgttgcaccgatagcatggccgccagagttccaatagaggagctccgagagttccgccacctccgggggcactgtcgagaagacgttgtaggtgtccagcgctctggtcgccccctctgcctccggccgccccgggcccgggaccgcgccctcctctgggccgcccggcctcgccttctcctcagcctccaacaggtgcccgagcccagcctgccggacttcattctcaaacagtcccgagaccggctccggattcaccggcaccgccaggtggttacaggagacgtgggtcccctctgccgtggaagggttgccgtggttgggcagaaccatcagctcgcccacacagcgccagcagggcacagaggtgatgtagaggcgcgggtctgggatgggacttacgccccgaaagcggcccagcagatccagggcccgttccaggctctccagccccatggtgtgagacatgcaataaaacacgctattgattctcttcattaaaatctctatgtcatttattaggcacaaacttacatcgactttatgccccccgtaaaactccacagagtacgcgactgagggggtgcggagaggcgggacccgggtaccctttctaccaggggcgagcagcgcggcagaggcctctctcgagttctctagcaggtgcaccagctccagggacagggcgctgcatgcacggtcattctgccgtctcaaacggggaaggaggatggcctccagctcggccagcaggccggcgttgcgcaccaccgcagccacgtccagactcctggggtccagccgggcgcacacgctcagctcaaccgccagggcgtacacctggctgtacgccgccgccagcagccccgacatcgccgccccaggggtctctagacctcgagtccggggagaacggtggccagacggcgcttgcgcctgcccccggagccctgccctcctccacccagcagcagcccggccgaggcctgcgacgcggtgccgaccggctcggccacgctgataaagttgtcctgggctgccccgggcccaccccacactccctccagaaagtcccgagcggcccccgccgtccactctatcccgctggaggcaatggtcgccagggtttctaggacgctgtccgccaggacggagaagcggcccaataagtactccgcgtcgtccctagtcagcgaggcgcatgcctcgcccatggcatccacaaggttgcacaccacatcaaacacacagtcttcctcctgtttttgtgatataatggcctccaggccagccctgatgttctcaatctcatatgtggtcgcggcttgggtccggcgcttcacggtcaaccctagggtgggggtggcaaagacaaacttcttccgcatggaagagcccccggcctgcttgcgcagcccagccccgggggcctgcagcaggttcctgtccacgccccggcccataaagtatcccaggttcccggcctggaatatctggttgttgccgttgacccccgtgtacttgttgatggtcactggcagcgtgacaaccggacgggccttgcagacctggctaagacagtctgtggccgcgcagaccaccgtggtcgcagtaagggaggaggtggcctccgcgtaggccgctgccgactccaccgcccgcgtgcccagtacgtgggggtagtcacgggcgggcaccgactgcgtcctcggcaccagtccctgaatcaggctgatgtagaactgggtctggccgcacgccttcaggatggcgttgttgagcctctgcttggcgtaagtgaccaggttgccaggcaccacatctatgacgttgctctcttcgtgggcccgggagcccccgtccacaaagagggccaggtcagagtactcctccgcgctggccccgctggggacagggaccgagcgccgcctggaaaagttgtgccacaggtacaggcttgagagcttagtgtccgggaatagggtcttgtggtaggtgttgaggaatttcatgtagggcccgttgatgatgtagttctccctcctggtagtggacttgatgaagctgttctggagggcggcgttctcccccgtgaagaccaccctgttcttgatcttgatgttcctggggcacagcatcagcaccttggacatgcgcaccggcagccgccggccgtacacccggccctgcagggccgcgtcgaggtctggcaggtcgcaggtgggctccccatgcaccaccttggcctccttggccgtgaggacccccttgtcgatggccaggctcctaaagttggtgcacagcgtctggtagtgaccctttagccactctggggggctctggccaagcccggggttgtcattctcatagcacatacagatgggcagggagatgtcctgcaggatggtcagcagtgagcggtaaaacaactgggtgaagacggggcaggcgggctgcgcaaaggggttgcacgagtactgcatcacgtggtagcagctcttgaccaggtccttgtaggtgatgttgttcttggccatgctgttcataaactggaccacttcggcgtccaccgccgcatccacgtccttgaacatcttgacaaagtcacgcgggccatggggctccttctctagctttccctcagcgtctatgcccagccgagacagccgctccagcaggttctggttcagctgccagtaggtgtagcggggctcgtcgtccggccgctgcccgtcgtcctccttatcgatgaagttgagaaagttgcccaaaaagtccgtctcgttgtaggagcccgaggcccccgagatcacataggggtccctccgctgcgtggacatgacgggggggaagcggtccctcagcctaaagaagagcgtgttcaggcacacggccggggcccggccctcgcagagcgagcacatggggctggcggccgcccccgccacgtagctgcccgtctccggcaccggggtcagagagctcttctgtccctggcaaaactgcaggtagtaggcatagcgggcaagaaggttgggcgagaaggaggccgcatagaccaggtgctccaccgcgtagtttcccggaccgttggttccggtcacgtctggcccaccccagcccgagaagcagggtcggcggcaggggtcccaggtcccctcctgcagggtccccaggccgtgggtcatgtagaaactgttaaagagactctccttgccctgaccggttgacttcgagacccccgagacgtaaaggacggaattggtggcaaagatctgcgtggacacgtggggggccaggctggcattatatcggtgtaacgcagccatacgggcctctgggccctcacagtcggcaaacaggggccaagagtcgtagttgaggcttgccggggtctcgtgcgaggcctccagcatggcgggcgcgtaactcaccgccagctcgcaggccgcgctgtccacaatcattaaggctcccgagtccgggtgactgatggttgaggctgggaactccttgaggggggccaccttggccaccttggcctggtcctgcaggctctgcttctccagcagctctaccagcttgcccacccgccggacgcgcagcgcctgcgccagcccggtgtacagcgcctcgtgcatgcagcggctgaggtccgagttgtaaaactggcggagctggggcacgccctctgggaacacctccttgtcgtagagcgggaccctaacgctcgcagactgccccaccgctacctcctgttttaacgatggaatggccaccaggtttccgctgtagagtcgctccttgaaggcctcggttattgccaccgcccccaggtaggcagagggatctagcccttcggggaagaagtcccccggcttggagctttctctcggtagggcgctgtaggcgtcgtacccaaacacctccctggtctcgccacagagggcctcgagacccggcccctcaaagatggggggaaccatatgggcattgtggaacacgtagatgtccctgtgataggaggtagcgcgtaggagcccgcagttggggtcgggcctcctgtgcagagccttgacattgatgctgaagcccggctccacggtgatgccgcaaaggagcggcaccgtcaggcacctgtggcccgcgtagccggtccccagtgtggccacctccctaagagggtaggtggccagggggtaaaagtagatgtagccgcacggacccggctggctctggctgcccagattatcctcgctagtctgtgcaccctgcatgatgcccaaggtatcgccccggcctcccagtcccacattaaatgttacactttactcatcacgcaacacccactgtttattcatttacaaagatttcaggaagtcagtcaggctggccagggcccacgtcacggggaactgacgtctcagcgatcttggcatgccgcccagcctcgcaaaccagagtctgcgatagagggccaggtagtgggcgattgcccccagcacgaaggcggcgctcttgtggtcatccaggtagtttcgcaccgcaaacaccactgtgtagcacagcaccaccctgagccgcgaccagtagtcgtagtggtcgttgtacactgcgcgcaggacgctgatgatgagccgtacgtgcgtgtctttgcccccgatgtcggctgtcctgcaggccagctctgcgtacagcttcctatccttcctcagggaggccttgatgagccggcagaggaccagggctggcaaaggcaggtctttctcatcccgggtgaacaccgcgtacatggccctgaacatgaggtagctggactcagccaccttgtcgtccggcggcgagggcgcgacccacgcctcgaccggggtcttcacaaacacagaatctgtagacttggctggcctcatggtctcgtcaggccagctcacgggcttcaggcttatatgataaaatgggcgtggcagaatagtataagacgcgaggcctgggtgaggagagtccagagcaatggccaggttcatcgctcagctcctcctgttggcctcctgcgtggccgccggccaggctgtcaccgctttcttgggtgagcgagtcaccctgacctcctactggaggagggtgagcctcggtccagagattgaggtcagctggtttaaactgggcccaggagaggagcaggtgcttattgggcgcatgcaccacgatgtcatctttatagagtggcctttcaggggcttctttgatatccacagaagtgccaacaccttctttttagtagtcaccgctgccaacatctcccatgacggcaactacctgtgccgcatgaaactgggcgagaccgaggtcaccaagcaggaacacctgagcgtggtgaagcctctaacgctgtctgtccactccgaaaggtctcagttcccagacttctctgtccttactgtgacatgcaccgtgaatgcatttccccatccccacgtccagtggctcatgcccgagggcgtggagcccgcaccaactgcggcaaatggcggtgttatgaaggaaaaggatgggagcctctctgttgctgttgacctgtcacttcccaagccctggcacctgccagtgacctgcgttgggaaaaatgacaaggaggaagcccacggggtttatgtttctggatacttgtcgcaataaacgcacttgcctatttcaccttgttttagtgtggcattggggggtggcattgcgggtggatagcctcgcgactcgtgggaaaatgggcggaagggcaccgtgggaaaatagttccaggtgacagcagcagtgtgtgaagattgtcacagctgctggtttggagaaaacgggggtgggcggtgatcagggagaacaattccccggggacacctgcacgagacccctgggctctcaggaactccgcccaggtctcgccaattggggtgatcctgtagcgccgcggtttcagcatcacaggttattttgcctgaagcttgctggggcgtaaatccctctcgccttgtttctcagagagcatttcaggccggttttgcagtcgctgctgcagctatggggtccctagaaatggtgccaatgggcgcgggtccccctagccccggcggggatccggatggggacgatggcggaaacaactcccaatatccatctgcttctggctcttctgggaacacccccaccccaccgaacgatgaggaacgtgaatctaatgaagagcccccaccgccttatgaggacccatattggggcaatggcgaccgtcactcggactatcaaccactaggaacccaagatcaaagtctgtacttgggattgcaacacgacgggaatgacgggctccctccccctccctactctccacgggatgactcatctcaacacatatatgaagaagcgggcagaggaaggtaagagtgccatctatctgtacttttatttattgcatcacaagtcacatcaataataagggcgccatctagcgggagatgttatccacaccatcccaattcacatctcagggacaacaggtcaaagttctttgttgacacccccagcgctggctccagggggtggcagcgttggatgcagtcctccgcatcggggcggacgcctcctcccaacgcgtttctgcggatcagtcgctggctggtgggcatcggagtcggtgggcggtcctccacggggacacgctccttcttggccttgttctttgaccttttggacattcttctgaaggaacggcggagagtagcgtagaatccagccagtggtctacccggtcgcatggtggcttcttagatgaggagcaggcataaaagtccaaacaggacacagagtaccaccaggagtagtcttagtctgctgacgtctgggtcctcggggcaggggtggctaggcctggtctccgtagaagagccgggcaggccgcaggcagaggactgctgctctagcaaagcacgctccaggacgtgtaccatctcgagagtgaggcacagctgttttcgtggacttttatacagtaaggacaaggaaagaaggccagaggaatgtggaaagatgagcgaggacaggtgtggaggttttgggctagctcttagtttctgggtgtgagagagggattaaagtgcttatgcgcaaagaatgtgtcaacaacaggtgttcctgcctctgctggcatgagttaggtgtggcttgggctgaatccaaatgtgtattggcacaagatggaaagcaaagttgctggagttactgggtgggagacagggatgtatgtggtcccccgctggtatgccagtaccctgtggaagtaaggggcctcatctgcccggtagttgtgttgtgcagaggtctgatgtgtgtaggaggggtgggttcaacgcaggggcgttggtggcggagtctggcaacgcccgggtccttgctacctgtgtggtgtgtgaagggctgggtaaaggtgtctgccaattctcgcatgtcctcctttccccttgttttgaaatagaatatgaatgtggcttttcagcctagacagacagtgtggctaagggagtgtgtgccagttaaggtgattagctaaggcattcccagtaaatggagggagagtcagtcaggcaagcctatgacatggtaatgcctagaagtaaagaaaggttagtcatagtagcttagctgaactgggccgtgggggtcgtcatcatctccaccggaaccagaagtacccaaaagcagcgtaggaaggtgtggatcaccgccgccaccgtctgtcatcgaaggcgggtcccggtcacctcctttgttttcaacctcttccgtcaaatttggagggcctccatcatttccagcagagtcgctagggttatgaggcagcgggtcatgtgggccattgtcatcagtgttgtcagggtcctgtgggccattgtcatcagtgttgtcagggtcctgaggcagcgggtcatgtgggccattgtcatcagtgttgtcagggtcctgtgggccattgtcatcagtgttgtcagggtcctgtgggccattgtcaggaccacctccaggtgcgcctaggttttgagagcagagtgggggtccgtcgccggccccactcacgagcaggtggtgtctgccctcgttggagttagagtcagattcatggctagaatcgtcggtagcttgttgagggtgcgggagggagtcatcgtggtggtgttcatcagtgtgtcgtggtccatgataatacatccagattaaaatggccataaacaggaggagccaaaggagatcaaccaatagagtccaccagttttgttgtagatagagagcaataataagcaggatgatggctaggaagaaggctaggatgaaggccaaaagctgccagatggtggcaccaagccgccagagaatctccaagaagtagatccagagacctaagactgcgttgaaaaaaagagtgttagggctggaaaggtgagggtgtggtaaataagtcctagggaatgttagatcttaccaagtaagcagccaaagatgaacagcacaattccaaggtacaatgcctgtccgtgcaaattccagagagcgatgagtaggagggtgactggggaaagaggagaaagtgcgttagagaaggaagcgtaagggaaagggggtggggggcaaagggtgtaatacttactcatcagtaggagtagaccaaggcctccaagtggacagagaaggtctcttctgaagataaagatgatgagaatgataataataagcatgagagcaaaggaatagaggacaaggagcgctcctccagtccagttactcataacgatatacagccagaacagtagcgccaagagcaggagaaggagagcaaggcctatggaagaggagagggggggtcctagagggggccgtggcgggcccggtgggcccctctcaaggtcgcgttccatggtcagggtagtgtggcaggagcaaggcaactgaggaaagaagctgacagagcagtgacagaggcttatgtaggccgcctacgagagagcaacgcgtgtttctggggatggaggcccggggggatttgcggggtctgccggaggcagtacgggcgccgctttcccgaaagcggcgtagtgtgtgtgcatgtaagcgttaaaagaggaagtagaaagcgtgtgtttgtgttagaaaagcgagtccccgaggggcaagctgtgggaatgcggtggtaaagcgtagcaggaaatggaaaggcagtgcggcaatcacaagggggagtgagcagtgttgtgggaagcggcagtgtaatccacacaaagaggcgtagggcgcgcaacgttgggaggtcgttgtcggcaggcgggaggctgtgctttaggggggttcaggtgaggcaaggctgtggggtaaccgtaggggaggcgggtgaggcggataagagggctaagggtcggcgggtgacgaagcagcagacgggggatatgggaatttcagaatgaggtggcggattccggcgaaaagggtgtgggctgtgcaagtgtcatgaggcaggcgcggaaagtcgctgcggcttgctggcgtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtttgtaagaaaattggttcaccgaatggatgtctggctgatagctcttctcatagaactgctgctctgggtgctgggaaaaatgattcaggagttctcgtctaccggtctctgccttttgacccagaacatgatgttcttgggcctgatgtgctccgtatggactcacttgggtatggcgttggagaagaccctagcattgttcagccgaacgcccaagagaacctcccacagaaatgtgtgcctgtacctgatgggcgtgttttgtctggtactcctgctgattatcatcctcctcattaccatgggccccgacgccaatctcaacagaggccccaacatgtgcagggaaggccccaccaaaggcatgcacacggccgtccaaggactgaaagccggctgctacctactggcggcagtcctgatcgtcctcctcacagttatcatcatctggaaacttttgcgcacaaaattcggaaggaagccgcgcctgatatgcaacgtcaccttcaccggactcatttgcgccttctcctggtttatgctgtccctgccgctgctcttcctgggtgaggccgggagcctggggtttgattgcacagagtctctcgttgcccgctactacccaggccccgccgcctgtttggccctgttgctcattatactatacgcctggagcttcagccattttatggactctctcaagaaccaggtgacagtcaccgccagatacttcagaagggtgcctagccagtccacctgagtgcgaggatggccctgcaaactgacacacaggcctggcgggtggagatagggaccagaggactaatgttctctaactgtgtcccactccacctgccggagggacagtaccacaagctccggctgcccgtctcggccttaaggatgcatgtttaaactcgaccaattctcatgtttgacagcttatcatcgaatttctgccattcatccgcttattatcacttattcaggcgtagcaaccaggcgtttaagggcaccaataactgccttaaaaaaattacgccccgccctgccactcatcgcagtactgttgtaattcattaagcattctgccgacatggaagccatcacaaacggcatgatgaacctgaatcgccagcggcatcagcaccttgtcgccttgcgtataatatttgcccatggtgaaaacgggggcgaagaagttgtccatattggccacgtttaaatcaaaactggtgaaactcacccagggattggctgagacgaaaaacatattctcaataaaccctttagggaaataggccaggttttcaccgtaacacgccacatcttgcgaatatatgtgtagaaactgccggaaatcgtcgtggtattcactccagagcgatgaaaacgtttcagtttgctcatggaaaacggtgtaacaagggtgaacactatcccatatcaccagctcaccgtctttcattgccatacggaattccggatgagcattcatcaggcgggcaagaatgtgaataaaggccggataaaacttgtgcttatttttctttacggtctttaaaaaggccgtaatatccagctgaacggtctggttataggtacattgagcaactgactgaaatgcctcaaaatgttctttacgatgccattgggatatatcaacggtggtatatccagtgatttttttctccattttagcttccttagctcctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatttattctgcgaagtgatcttccgtcacaggtatttattcgcgataagctcatggagcggcgtaaccgtcgcacaggaaggacagagaaagcgcggatctgggaagtgacggacagaacggtcaggacctggattggggaggcggttgccgccgctgctgctgacggtgtgacgttctctgttccggtcacaccacatacgttccgccattcctatgcgatgcacatgctgtatgccggtataccgctgaaagttctgcaaagcctgatgggacataagtccatcagttcaacggaagtctacacgaaggtttttgcgctggatgtggctgcccggcaccgggtgcagtttgcgatgccggagtctgatgcggttgcgatgctgaaacaattatcctgagaataaatgccttggcctttatatggaaatgtggaactgagtggatatgctgtttttgtctgttaaacagagaagctggctgttatccactgagaagcgaacgaaacagtcgggaaaatctcccattatcgtagagatccgcattattaatctcaggagcctgtgtagcgtttataggaagtagtgttctgtcatgatgcctgcaagcggtaacgaaaacgatttgaatatgccttcaggaacaatagaaatcttcgtgcggtgttacgttgaagtggagcggattatgtcagcaatggacagaacaacctaatgaacacagaaccatgatgtggtctgtccttttacagccagtagtgctcgccgcagtcgagcgacagggcgaagccctcgagtgagcgaggaagcaccagggaacagcacttatatattctgcttacacacgatgcctgaaaaaacttcccttggggttatccacttatccacggggatatttttataattatttttttatagtttttagatcttcttttttagagcgccttgtaggcctttatccatgctggttctagagaaggtgttgtgacaaattgccctttcagtgtgacaaatcaccctcaaatgacagtcctgtctgtgacaaattgcccttaaccctgtgacaaattgccctcagaagaagctgttttttcacaaagttatccctgcttattgactcttttttatttagtgtgacaatctaaaaacttgtcacacttcacatggatctgtcatggcggaaacagcggttatcaatcacaagaaacgtaaaaatagcccgcgaatcgtccagtcaaacgacctcactgaggcggcatatagtctctcccgggatcaaaaacgtatgctgtatctgttcgttgaccagatcagaaaatctgatggcaccctacaggaacatgacggtatctgcgagatccatgttgctaaatatgctgaaatattcggattgacctctgcggaagccagtaaggatatacggcaggcattgaagagtttcgcggggaaggaagtggttttttatcgccctgaagaggatgccggcgatgaaaaaggctatgaatcttttccttggtttatcaaacgtgcgcacagtccatccagagggctttacagtgtacatatcaacccatatctcattcccttctttatcgggttacagaaccggtttacgcagtttcggcttagtgaaacaaaagaaatcaccaatccgtatgccatgcgtttatacgaatccctgtgtcagtatcgtaagccggatggctcaggcatcgtctctctgaaaatcgactggatcatagagcgttaccagctgcctcaaagttaccagcgtatgcctgacttccgccgccgcttcctgcaggtctgtgttaatgagatcaacagcagaactccaatgcgcctctcatacattgagaaaaagaaaggccgccagacgactcatatcgtattttccttccgcgatatcacttccatgacgacaggatagtctgagggttatctgtcacagatttgagggtggttcgtcacatttgttctgacctactgagggtaatttgtcacagttttgctgtttccttcagcctgcatggattttctcatactttttgaactgtaatttttaaggaagccaaatttgagggcagtttgtcacagttgatttccttctctttcccttcgtcatgtgacctgatatcgggggttagttcgtcatcattgatgagggttgattatcacagtttattactctgaattggctatccgcgtgtgtacctctacctggagtttttcccacggtggatatttcttcttgcgctgagcgtaagagctatctgacagaacagttcttctttgcttcctcgccagttcgctcgctatgctcggttacacggctgcggcgagcgctagtgataataagtgactgaggtatgtgctcttcttatctccttttgtagtgttgctcttattttaaacaactttgcggttttttgatgactttgcgattttgttgttgctttgcagtaaattgcaagatttaataaaaaaacgcaaagcaatgattaaaggatgttcagaatgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacgggttgagcaacgtgttggttatacaattgaacaaattaatcatatgcgtgatgtgtttggtacgcgattgcgacgtgctgaagacgtatttccaccggtgatcggggttgctgcccataaaggtggcgtttacaaaacctcagtttctgttcatcttgctcaggatctggctctgaaggggctacgtgttttgctcgtggaaggtaacgacccccagggaacagcctcaatgtatcacggatgggtaccagatcttcatattcatgcagaagacactctcctgcctttctatcttggggaaaaggacgatgtcacttatgcaataaagcccacttgctggccggggcttgacattattccttcctgtctggctctgcaccgtattgaaactgagttaatgggcaaatttgatgaaggtaaactgcccaccgatccacacctgatgctccgactggccattgaaactgttgctcatgactatgatgtcatagttattgacagcgcgcctaacctgggtatcggcacgattaatgtcgtatgtgctgctgatgtgctgattgttcccacgcctgctgagttgtttgactacacctccgcactgcagtttttcgatatgcttcgtgatctgctcaagaacgttgatcttaaagggttcgagcctgatgtacgtattttgcttaccaaatacagcaatagtaatggctctcagtccccgtggatggaggagcaaattcgggatgcctggggaagcatggttctaaaaaatgttgtacgtgaaacggatgaagttggtaaaggtcagatccggatgagaactgtttttgaacaggccattgatcaacgctcttcaactggtgcctggagaaatgctctttctatttgggaacctgtctgcaatgaaattttcgatcgtctgattaaaccacgctgggagattagataatgaagcgtgcgcctgttattccaaaacatacgctcaatactcaaccggttgaagatacttcgttatcgacaccagctgccccgatggtggattcgttaattgcgcgcgtaggagtaatggctcgcggtaatgccattactttgcctgtatgtggtcgggatgtgaagtttactcttgaagtgctccggggtgatagtgttgagaagacctctcgggtatggtcaggtaatgaacgtgaccaggagctgcttactgaggacgcactggatgatctcatcccttcttttctactgactggtcaacagacaccggcgttcggtcgaagagtatctggtgtcatagaaattgccgatgggagtcgccgtcgtaaagctgctgcacttaccgaaagtgattatcgtgttctggttggcgagctggatgatgagcagatggctgcattatccagattgggtaacgattatcgcccaacaagtgcttatgaacgtggtcagcgttatgcaagccgattgcagaatgaatttgctggaaatatttctgcgctggctgatgcggaaaatatttcacgtaagattattacccgctgtatcaacaccgccaaattgcctaaatcagttgttgctcttttttctcaccccggtgaactatctgcccggtcaggtgatgcacttcaaaaagcctttacagataaagaggaattacttaagcagcaggcatctaaccttcatgagcagaaaaaagctggggtgatatttgaagctgaagaagttatcactcttttaacttctgtgcttaaaacgtcatctgcatcaagaactagtttaagctcacgacatcagtttgctcctggagcgacagtattgtataagggcgataaaatggtgcttaacctggacaggtctcgtgttccaactgagtgtatagagaaaattgaggccattcttaaggaacttgaaaagccagcaccctgatgcgaccacgttttagtctacgtttatctgtctttacttaatgtcctttgttacaggccagaaagcataactggcctgaatattctctctgggcccactgttccacttgtatcgtcggtctgataatcagactgggaccacggtcccactcgtatcgtcggtctgattattagtctgggaccacggtcccactcgtatcgtcggtctgattattagtctgggaccacggtcccactcgtatcgtcggtctgataatcagactgggaccacggtcccactcgtatcgtcggtctgattattagtctgggaccatggtcccactcgtatcgtcggtctgattattagtctgggaccacggtcccactcgtatcgtcggtctgattattagtctggaaccacggtcccactcgtatcgtcggtctgattattagtctgggaccacggtcccactcgtatcgtcggtctgattattagtctgggaccacgatcccactcgtgttgtcggtctgattatcggtctgggaccacggtcccacttgtattgtcgatcagactatcagcgtgagactacgattccatcaatgcctgtcaagggcaagtattgacatgtcgtcgtaacctgtagaacggagtaacctcggtgtgcggttgtatgcctgctgtggattgctgctgtgtcctgcttatccacaacattttgcgcacggttatgtggacaaaatacctggttacccaggccgtgccggcacgtttaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctggtttagtgaaccgtcagatccgctagcgctaccggtcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggactcagatctcgagctcaagcttcgaattctgcagtcgacggtaccgcgggcccgggatccaccggatctagataactgatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttaacgcgaaccgggctgcatccgatgcaagtgtgtcgctgtcgagaagcttggctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaatttttttatttatgcagaggccgaggccgcctcggcctctgagctattccagaagtagtgaggaggcttttttggaggcctaggcttttgcaaaaagctcagatctgcgggggggccctccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggcccgggcaacttgtttattgcagcttataatggttacaaataaagcaatagcatcacaaatttcacaaataaagcatttttttcactgcattctagttgtggtttgtccaaactcatcaatgtatcttatcatgtctggatccgcatcgatggcccgtgcggccaggccctggcccaccggtttccagcgatacgtcgatgggcagctatattcaccttgaggtgccacagagcatcagatgagactttgtttaaacgagcccaaactctcccgtacccaccccccctccccaatggggctggcagtccttgtgtctctatcaaggaaacaaaaccactgacctggttaacagacttcaggtggtcatgtttccctccaagcggcacagattagaagatgatgcataaaattttattctacatcatgcctggttcggtggggtcgtgactatataggggaggtaaggcgacatatagcccgggcgagacatagtggatagcggtgctatggacctgtattcacagcacgtcacttccactaagaccccccacgggtttgttaaccccttctccggtgaggagatgccgaggcaagtagccctggtgacacctggtgcctacgtgatgtgctaggcacttatttacagcacaccagcagcatcaggtcccaccaaatgttacagagccccccccccccccgtatagatttgagaaggtaaaagtggcactgaggcaagtagcctccggtgacacctggtgactagtggtgcgctggacacttatttacagcacaacactaacactaggttccaccaaaggttaacaatgccttgttcttaggtggtgtgtgtttacagggattatcaagacaaggagctccggtaggacctataggataggggtacccgaggcacagcactcccactagttcccactaaagattaacaaagcacctaggtggaggcccgtactggttagaaagatgcacttgcatattccgggcctcagccatcggcccggggggagggcacgtgtgaggaccaccggacaccgcggagggccaaactccgcggtccttatcagttttctgcccgtttactgatagaatgttagcttggattagctgttagtattctgaggcagacattttgcaccaggccgggggaggtagaatatttgcatgaaggcaggaaacccagggcacattagcaatgttctaggcacgcaaatgcctacatcaggcctaaagccacctgaggaacaactttggcctgagcaattccttatagctggtgtatttttggccctttctactcaatcgtgtcagctccttcccccacccgccgtgtctggctcaccatcccccgcaaaactcggtttacataccctgatcccatttttagcgatctcttacctcacatgaagaggctagtgcctacgtgactccctgctcctgccagtttcccttcgaggtctccatgttgctgaggagcttcttaggcctgctgccactcgtggtttagcagcttgaaaaatggcaaccggcagctcctcttccgggtatggctgttgttgcagaatatgaaagtgatcctaagcacaccccaccacatatttaggcctgagaagcagggagttttaaaactgacagtttaggaatgactcatttagtgcttctattgtgctgctgtgtggggtctgtttgtgcatttttctcagatctggttaaatttgaaaatgtcgtggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatggtggggcatggggggcgcattcctggaaaaagtggagggggcgtggccttcccccgcggtcccctggcccccccgcacagagaggcgcaacggggggcgggcggcgagggggtcggggtccgcgggctccgggggctgcgggcgttggacggcggcggacgttcaggggatgggggggtctgggggcgctgcgcgggcgcagccatgcgtgaccgtgaggaggggggctggcgcgcggggggcgtgtctggtgggggcgggagcggggggcggcgcgggagcctgcacgccgttggagggtggaatgacaggggggcggggacagagaggcggtcgcgcccccggccgcggcagccaagcccccaaggggggcggggagcgggcaatggagcgtgacgaacggccccagggcaaacgtgacgcggggctccggggtgaccagggctgaccccggcaaacgtgacccggggctccgggggtacccagccaagcgtgaccaaggggcccctggtgactcaggcacagctgacaaagaaggccccccaggaaagacccccggggggcatcgggggggataaatgggggcatgg

SEQ ID NO: 12 - DNA, 33 bp, Artificial
  EBNA1for
tagcggccgcacagtcatcatcatccgggtctc

SEQ ID NO: 13 - DNA, 48 bp, Artificial
  EBNA1rev
tttcatagatcttaatggtgatggtgatgatgcgcggcagccccttcc

SEQ ID NO: 14 - DNA, 32 bp, Artificial
  gp350 for
cgtagcggccgcaatggaggcagccttgcttg

SEQ ID NO: 15 - DNA, 52 bp, Artificial
  gp350 rev
tttcatagatcttaatggtgatggtgatgatgggtggatacagtggggcctg

SEQ ID NO: 16 - DNA, 74 bp, Artificial
  GalKfwd
gagcagggtgaacacttgggcacggagagtgccctggaggcctcaggcaacctgttgacaattaatcatcggca

SEQ ID NO: 17 - DNA, 70 bp, Artificial
  Galkrev
atgtggaaggccttgccatccagtctggtccgtaggcatacacatagttgtcagcactgtcctgctcctt

SEQ ID NO: 18 - DNA, 74 bp, Artificial; identical to SEQ ID NO: 16
  GalKfwd2

SEQ ID NO: 19 - DNA, 70 bp, Artificial; identical to SEQ ID NO: 17
  GalKrev2

SEQ ID NO: 20 - DNA, 78 bp, Artificial
  E3Cfwd
gagcagggtgaacacttgggcacggagagtgccctggaggcctcaggcaatgcaccacctaatgaaaatccatatcac

SEQ ID NO: 21 - DNA, 69 bp, Artificial
  E3Crev
atgtggaaggccttgccatccagtctggtccgtaggcatacacatagttgcctgacgcaggtttacggc

SEQ ID NO: 22 - DNA, 73 bp, Artificial
  E1-E3fwd
agcagggtgaacacttgggcacggagagtgccctggaggcctcaggcaacaatgcaccacctaatgaaaatcc

SEQ ID NO: 23 - DNA, 69 bp, Artificial
  E1-E3Crev
catgtggaaggccttgccatccagtctggtccgtaggcatacacatagtttccaggggccattccaaag

SEQ ID NO: 24 - DNA, 73 bp, Artificial; identical to SEQ ID NO: 22
  E1-E3fwd2

SEQ ID NO: 25 - DNA, 69 bp, Artificial; identical to SEQ ID NO: 23
  E1-E3Crev2

SEQ ID NO: 26 - DNA, 38 bp, Artificial
  E1RIfwd
taatccctcaggccagtcatcatcatccgggtctccac

SEQ ID NO: 27 - DNA, 41 bp, Artificial
  E1RIrev
ttagatcctgaggcactacctccatatacgaacacaccggc

SEQ ID NO: 28 - DNA, 28 bp, Artificial
  E1RIIfwd
ggcactaccgacgaaggaacttgggtcg

SEQ ID NO: 29 - DNA, 21 bp, Artificial
  E1RIIrev
ggccgcggcagccccttccac

SEQ ID NO: 30 - DNA, 28 bp, Artificial
  E1RI:IIfwd
ggcactaccgacgaaggaacttgggtcg

SEQ ID NO: 31 - DNA, 21 bp, Artificial
  E1RI:IIrev
ggccgcggcagccccttccac

SEQ ID NO: 32 - protein, 15 aa, Artificial
  EBNA1 3E10 epitope
NPKFENIAEGLRALL

SEQ ID NO: 33 - protein, 15 aa, Artificial
  EBNA 3G2 epitope
KTSLYNLRRGTALAI

SEQ ID NO: 34 - protein, 15 aa, Artificial
  EBNA3C 5H11 epitope
ENPYHARRGIKEHVI

SEQ ID NO: 35 - protein, 14 aa, Artificial
  EBNA-3C 3H10
VVRMFMRERQLPQS

SEQ ID NO: 36 - protein, 280 aa, Artificial
  EBNA1 epitope-rich sequence
RARGGSRERARGRGRGRGEKRPRSPSSQSSSSGSPPRRPPPGRRPFFHPVGEADYFEYHQEGGPDGEPDVPPGAIEQGPADDPGEGPSTGPRGQGDGGRRKKGGWFGKHRGQGGSNPKFENIAEGLRALLARSHVERTTDEGTWVAGVFVYGGSKTSLYNLRRGTALAIPQCRLTPLSRLPFGMAPGPGPQPGPLRESIVCYFMVFLQTHIFAEVLKDAIKDLVMTKPAPTCNIRVTVCSFDDGVDLPPWFPPMVEGAAAEGDDGDDGDEGGDGDEGEEG

SEQ ID NO: 37 - protein, 15 aa, Human herpesvirus 4
RRPQKRPSCIGCKGT

SEQ ID NO: 38 - protein, 15 aa, Human herpesvirus 4
RPFFHPVGEADYFEY

SEQ ID NO: 39 - protein, 13 aa, Human herpesvirus 4
FEYHQEGGPDGEP

SEQ ID NO: 40 - protein, 20 aa, Human herpesvirus 4
VPPGAIEQGPADDPGEGPST

SEQ ID NO: 41 - protein, 25 aa, Human herpesvirus 4
IEQGPADDPGEGPSTGPRGQGDGGR

SEQ ID NO: 42 - protein, 15 aa, Human herpesvirus 4
DGGRRKKGGWFGKHR

SEQ ID NO: 43 - protein, 20 aa, Human herpesvirus 4
SNPKFENIAEGLRALLARSH

SEQ ID NO: 44 - protein, 20 aa, Human herpesvirus 4
ENIAEGLRALLARSHVERTT

SEQ ID NO: 45 - protein, 15 aa, Human herpesvirus 4
IAEGLRALLARSHVE

SEQ ID NO: 46 - protein, 20 aa, Human herpesvirus 4
IAEGLRALLARSHVERTTDE

SEQ ID NO: 47 - protein, 15 aa, Human herpesvirus 4
LRALLARSHVERTTD

SEQ ID NO: 48 - protein, 25 aa, Human herpesvirus 4
DEGTWVAGVFVYGGSKTSLYNLRRG

SEQ ID NO: 49 - protein, 20 aa, Human herpesvirus 4
VYGGSKTSLYNLRRGTALAI

SEQ ID NO: 50 - protein, 15 aa, Human herpesvirus 4
KTSLYNLRRGTALAI

SEQ ID NO: 51 - protein, 14 aa, Human herpesvirus 4
TSLYNLRRGTALAI

SEQ ID NO: 52 - protein, 13 aa, Human herpesvirus 4
YNLRRGTALAIPQ

SEQ ID NO: 53 - protein, 15 aa, Human herpesvirus 4
NLRRGTALAIPQCRL

SEQ ID NO: 54 - protein, 15 aa, Human herpesvirus 4
AIPQCRLTPLSRLPF

SEQ ID NO: 55 - protein, 15 aa, Human herpesvirus 4
PQCRLTPLSRLPFGM

SEQ ID NO: 56 - protein, 11 aa, Human herpesvirus 4
RLTPLSRLPFG

SEQ ID NO: 57 - protein, 20 aa, Human herpesvirus 4
APGPGPQPGPLRESIVCYFM

SEQ ID NO: 58 - protein, 20 aa, Human herpesvirus 4
PQPGPLRESIVCYFMVFLQT

SEQ ID NO: 59 - protein, 20 aa, Human herpesvirus 4
PGPLRESIVCYFMVFLQTHI

SEQ ID NO: 60 - protein, 20 aa, Human herpesvirus 4
LRESIVCYFMVFLQTHIFAE

SEQ ID NO: 61 - protein, 25 aa, Human herpesvirus 4
LRESIVCYFMVFLQTHIFAEVLKDA

SEQ ID NO: 62 - protein, 13 aa, Human herpesvirus 4
YFMVFLQTHIFAE

SEQ ID NO: 63 - protein, 15 aa, Human herpesvirus 4
MVFLQTHIFAEVLKD

SEQ ID NO: 64 - protein, 19 aa, Human herpesvirus 4
VFLQTHIFAEVLKDAIKDL

SEQ ID NO: 65 - protein, 20 aa, Human herpesvirus 4
VLKDAIKDLVMTKPAPTCNI

SEQ ID NO: 66 - protein, 25 aa, Human herpesvirus 4
PTCNIRVTVCSFDDGVDLPPWFPPM

SEQ ID NO: 67 - protein, 20 aa, Human herpesvirus 4
RVTVCSFDDGVDLPPWFPPM

SEQ ID NO: 68 - protein, 13 aa, Human herpesvirus 4
PPWFPPMVEGAAA

SEQ ID NO: 69 - protein, 15 aa, Human herpesvirus 4
NRGWMQRIRRRRRRR

SEQ ID NO: 70 - protein, 20 aa, Human herpesvirus 4
PHDITPYTARNIRDAACRAV

SEQ ID NO: 71 - protein, 15 aa, Human herpesvirus 4
ILCFVMAARQRLQDI

SEQ ID NO: 72 - protein, 15 aa, Human herpesvirus 4
SDDELPYIDPNMEPV

SEQ ID NO: 73 - protein, 15 aa, Human herpesvirus 4
QQRPVMFVSRVPAKK

SEQ ID NO: 74 - protein, 15 aa, Human herpesvirus 4
QKRAAPPTVSPSDTG

SEQ ID NO: 75 - protein, 14 aa, Human herpesvirus 4
PAAGPPAAGPRILA

SEQ ID NO: 76 - protein, 15 aa, Human herpesvirus 4
PPVVRMFMRERQLPQ

SEQ ID NO: 77 - protein, 13 aa, Human herpesvirus 4
VVRMFMRERQLPQ

SEQ ID NO: 78 - protein, 15 aa, Human herpesvirus 4
PQCFWEMRAGREITQ

SEQ ID NO: 79 - protein, 20 aa, Human herpesvirus 4
PAPQAPYQGYQEPPAPQAPY

SEQ ID NO: 80 - protein, 15 aa, Human herpesvirus 4
PSMPFASDYSQGAFT

SEQ ID NO: 81 - protein, 16 aa, Human herpesvirus 4
AQEILSDNSEISVFPK

SEQ ID NO: 82 - protein, 20 aa, Human herpesvirus 4
GQTYHLIVDTDSLGNPSLSV

SEQ ID NO: 83 - protein, 12 aa, Human herpesvirus 4
LGNPSLSVIPSN

SEQ ID NO: 84 - protein, 20 aa, Human herpesvirus 4
IPLTIFVGENTGVPPPLPPP

SEQ ID NO: 85 - protein, 20 aa, Human herpesvirus 4
MRMLWMANYIVRQSRGDRGL

SEQ ID NO: 86 - protein, 15 aa, Human herpesvirus 4
MANYIVRQSRGDRGL

SEQ ID NO: 87 - protein, 20 aa, Human herpesvirus 4
LPPATLTVPPRPTRPTTLPP

SEQ ID NO: 88 - protein, 20 aa, Human herpesvirus 4
PRSPTVFYNIPPMPLPPSQL

SEQ ID NO: 89 - protein, 11 aa, Human herpesvirus 4
TVFYNIPPMPL

SEQ ID NO: 90 - protein, 20 aa, Human herpesvirus 4
PAQPPPGVINDQQLHHLPSG

SEQ ID NO: 91 - protein, 20 aa, Human herpesvirus 4
VCRNSHTATPNVSPIHEPES

SEQ ID NO: 92 - protein, 15 aa, Human herpesvirus 4
VKFTPDPYQVPFVQA

SEQ ID NO: 93 - protein, 15 aa, Human herpesvirus 4
LTAYHVSTAPTGSWF

SEQ ID NO: 94 - protein, 15 aa, Human herpesvirus 4
PGDNSTVQTAAAVVF

SEQ ID NO: 95 - protein, 15 aa, Human herpesvirus 4
ELEIKRYKNRVASRK

SEQ ID NO: 96 - protein, 15 aa, Human herpesvirus 4
KSSENDRLRLLLKQM

SEQ ID NO: 97 - protein, 11 aa, Human herpesvirus 4
HPVGEADYFEY

SEQ ID NO: 98 - protein, 15 aa, Human herpesvirus 4
NPKFENIAEGLRALL

SEQ ID NO: 99 - protein, 19 aa, Human herpesvirus 4
GGSNPKFENIAEGLRALLA

SEQ ID NO: 100 - protein, 19 aa, Human herpesvirus 4
VAGVFVYGGSKTSLYNLRR

SEQ ID NO: 101 - protein, 9 aa, Human herpesvirus 4
IPQCRLTPL

SEQ ID NO: 102 - protein, 9 aa, Human herpesvirus 4
VLKDAIKDL

SEQ ID NO: 103 - protein, 10 aa, Human herpesvirus 4
YHLIVDTDSL

SEQ ID NO: 104 - protein, 10 aa, Human herpesvirus 4
DTPLIPLTIF

SEQ ID NO: 105 - protein, 9 aa, Human herpesvirus 4
RPTELQPTP

SEQ ID NO: 106 - protein, 9 aa, Human herpesvirus 4
QAKWRLQTL

SEQ ID NO: 107 - protein, 9 aa, Human herpesvirus 4
AYSSWMYSY

SEQ ID NO: 108 - protein, 8 aa, Human herpesvirus 4
RYSIFFDY

SEQ ID NO: 109 - protein, 9 aa, Human herpesvirus 4
FLRGRAYGI

SEQ ID NO: 110 - protein, 20 aa, Human herpesvirus 4
EDLPCIVSRGGPKVKRPPIF

SEQ ID NO: 111 - protein, 10 aa, Human herpesvirus 4
KRPPIFIRRL

SEQ ID NO: 112 - protein, 9 aa, Human herpesvirus 4
RPPIFIRRL

SEQ ID NO: 113 - protein, 9 aa, Human herpesvirus 4
LEKARGSTY

SEQ ID NO: 114 - protein, 9 aa, Human herpesvirus 4
HLAAQGMAY

SEQ ID NO: 115 - protein, 9 aa, Human herpesvirus 4
YPLHEQHGM

SEQ ID NO: 116 - protein, 9 aa, Human herpesvirus 4
VFSDGRVAC

SEQ ID NO: 117 - protein, 9 aa, Human herpesvirus 4
VPAPAGPIV

SEQ ID NO: 118 - protein, 9 aa, Human herpesvirus 4
RLRAEAQVK

SEQ ID NO: 119 - protein, 9 aa, Human herpesvirus 4
VQPPQLTQV

SEQ ID NO: 120 - protein, 19 aa, Human herpesvirus 4
QVADVVRAPGVPAMQPQYF

SEQ ID NO: 121 - protein, 9 aa, Human herpesvirus 4
HRCQAIRKK

SEQ ID NO: 122 - protein, 9 aa, Human herpesvirus 4
TYSAGIVQI

SEQ ID NO: 123 - protein, 9 aa, Human herpesvirus 4
VSFIEFVGW

SEQ ID NO: 124 - protein, 10 aa, Human herpesvirus 4
AVFDRKSDAK

SEQ ID NO: 125 - protein, 9 aa, Human herpesvirus 4
IVTDFSVIK

SEQ ID NO: 126 - protein, 9 aa, Human herpesvirus 4
AVLLHEESM

SEQ ID NO: 127 - protein, 10 aa, Human herpesvirus 4
VEITPYKPTW

SEQ ID NO: 128 - protein, 9 aa, Human herpesvirus 4
EGGVGWRHW

SEQ ID NO: 129 - protein, 10 aa, Human herpesvirus 4
LRGKWQRRYR

SEQ ID NO: 130 - protein, 9 aa, Human herpesvirus 4
RRIYDLIEL

SEQ ID NO: 131 - protein, 8 aa, Human herpesvirus 4
HHIWQNLL

SEQ ID NO: 132 - protein, 10 aa, Human herpesvirus 4
EENLLDFVRF

SEQ ID NO: 133 - protein, 9 aa, Human herpesvirus 4
KEHVIQNAF

SEQ ID NO: 134 - protein, 9 aa, Human herpesvirus 4
FRKAQIQGL

SEQ ID NO: 135 - protein, 9 aa, Human herpesvirus 4
SLREWLLRI

SEQ ID NO: 136 - protein, 9 aa, Human herpesvirus 4
YLLEMLWRL

SEQ ID NO: 137 - protein, 15 aa, Human herpesvirus 4
LWRLGATIWQLLAFF

SEQ ID NO: 138 - protein, 9 aa, Human herpesvirus 4
TLLVDLLWL

SEQ ID NO: 139 - protein, 15 aa, Human herpesvirus 4
SGHESDSNSNEGRHH

SEQ ID NO: 140 - protein, 15 aa, Human herpesvirus 4
TDGGGGHSHDSGHGG

SEQ ID NO: 141 - protein, 9 aa, Human herpesvirus 4
FWLYIVMSD

SEQ ID NO: 142 - protein, 11 aa, Human herpesvirus 4
FRRDLLCPLGA

SEQ ID NO: 143 - protein, 14 aa, Human herpesvirus 4
ASCFTASVSTVVTA

SEQ ID NO: 144 - protein, 9 aa, Human herpesvirus 4
FTASVSTVV

SEQ ID NO: 145 - protein, 15 aa, Human herpesvirus 4
STVVTATGLALSLLL

SEQ ID NO: 146 - protein, 14 aa, Human herpesvirus 4
SSYAAAQRKLLTPV

SEQ ID NO: 147 - protein, 9 aa, Human herpesvirus 4
IEDPPFNSL

SEQ ID NO: 148 - protein, 20 aa, Human herpesvirus 4
VLVMLVLLILAYRRRWRRLT

SEQ ID NO: 149 - protein, 9 aa, Human herpesvirus 4
RRRWRRLTV

SEQ ID NO: 150 - protein, 9 aa, Human herpesvirus 4
RRWRRLTVC

SEQ ID NO: 151 - protein, 11 aa, Human herpesvirus 4
RRLTVCGGIMF

SEQ ID NO: 152 - protein, 9 aa, Human herpesvirus 4
TVCGGIMFL

SEQ ID NO: 153 - protein, 14 aa, Human herpesvirus 4
MFLACVLVLIVDAV

SEQ ID NO: 154 - protein, 9 aa, Human herpesvirus 4
LIVDAVLQL

SEQ ID NO: 155 - protein, 11 aa, Human herpesvirus 4
SSCSSCPLSKI

SEQ ID NO: 156 - protein, 9 aa, Human herpesvirus 4
ILLARLFLY

SEQ ID NO: 157 - protein, 13 aa, Human herpesvirus 4
STEFIPNLFCMLL

SEQ ID NO: 158 - protein, 9 aa, Human herpesvirus 4
TYGPVFMCL

SEQ ID NO: 159 - protein, 9 aa, Human herpesvirus 4
CLGGLLTMV

SEQ ID NO: 160 - protein, 10 aa, Human herpesvirus 4
VMSNTLLSAW

SEQ ID NO: 161 - protein, 9 aa, Human herpesvirus 4
LLSAWILTA

SEQ ID NO: 162 - protein, 21 aa, Human herpesvirus 4
LDLDFGQLTPHTKAVYQPRGA

SEQ ID NO: 163 - protein, 15 aa, Human herpesvirus 4
FGQLTPHTKAVYQPR

SEQ ID NO: 164 - protein, 10 aa, Human herpesvirus 4
SRLVRAILSP

SEQ ID NO: 165 - protein, 9 aa, Human herpesvirus 4
VQTAAAVVF

SEQ ID NO: 166 - protein, 12 aa, Human herpesvirus 4
DSELEIKRYKNR

SEQ ID NO: 167 - protein, 15 aa, Human herpesvirus 4
RKCRAKFKQLLQHYR

SEQ ID NO: 168 - protein, 8 aa, Human herpesvirus 4
RAKFKQLL

SEQ ID NO: 169 - protein, 9 aa, Human herpesvirus 4
LQHYREVAA

SEQ ID NO: 170 - protein, 9 aa, Human herpesvirus 4
SENDRLRLL

SEQ ID NO: 171 - protein, 13 aa, Human herpesvirus 4
LPEPLPQGQLTAY

SEQ ID NO: 172 - protein, 11 aa, Human herpesvirus 4
EPLPQGQLTAY

SEQ ID NO: 173 - protein, 10 aa, Human herpesvirus 4
VSTAPTGSWF

SEQ ID NO: 174 - protein, 9 aa, Human herpesvirus 4
APENAYQAY

SEQ ID NO: 175 - protein, 10 aa, Human herpesvirus 4
TPDPYQVPFV

SEQ ID NO: 176 - protein, 11 aa, Human herpesvirus 4
DPYQVPFVQAF

SEQ ID NO: 177 - protein, 9 aa, Human herpesvirus 4
YQVPFVQAF

SEQ ID NO: 178 - protein, 9 aa, Human herpesvirus 4
LPCVLWPVL

SEQ ID NO: 179 - protein, 11 aa, Human herpesvirus 4
EPLPQGQLTAY

SEQ ID NO: 180 - protein, 10 aa, Human herpesvirus 4
HVSTAPTGSW

SEQ ID NO: 181 - protein, 9 aa, Human herpesvirus 4
STAPTGSWF

SEQ ID NO: 182 - protein, 10 aa, Human herpesvirus 4
APQPAPENAY

SEQ ID NO: 183 - protein, 11 aa, Human herpesvirus 4
QPAPENAYQAY

SEQ ID NO: 184 - protein, 10 aa, Human herpesvirus 4
TVQTAAAVVF

SEQ ID NO: 185 - protein, 9 aa, Human herpesvirus 4
VQTAAAVVF

SEQ ID NO: 186 - protein, 8 aa, Human herpesvirus 4
QTAAAVVF

SEQ ID NO: 187 - protein, 12 aa, Human herpesvirus 4
EECDSELEIKRY

SEQ ID NO: 188 - protein, 8 aa, Human herpesvirus 4
SELEIKRY

SEQ ID NO: 189 - protein, 9 aa, Human herpesvirus 4
RYKNRVASR

SEQ ID NO: 190 - protein, 15 aa, Human herpesvirus 4
RKCRAKFKQLLQHYR

SEQ ID NO: 191 - protein, 9 aa, Human herpesvirus 4
KCRAKFKQL

SEQ ID NO: 192 - protein, 9 aa, Human herpesvirus 4
CRAKFKQLL

SEQ ID NO: 193 - protein, 9 aa, Human herpesvirus 4
KFKQLLQHY

SEQ ID NO: 194 - protein, 10 aa, Human herpesvirus 4
LLQHYREVAA

SEQ ID NO: 195 - protein, 15 aa, Human herpesvirus 4
TLRFKTKALAVLSKC

SEQ ID NO: 196 - protein, 9 aa, Human herpesvirus 4
CYDHAQTHL

SEQ ID NO: 197 - protein, 15 aa, Human herpesvirus 4
FRNLAYGRTCVLGKE

SEQ ID NO: 198 - protein, 13 aa, Human herpesvirus 4
RPQGGSRPEFVKL

SEQ ID NO: 199 - protein, 9 aa, Human herpesvirus 4
TLDYKPLSV

SEQ ID NO: 200 - protein, 9 aa, Human herpesvirus 4
YRSGIIAVV

SEQ ID NO: 201 - protein, 10 aa, Human herpesvirus 4
LPLDLSVILF

SEQ ID NO: 202 - protein, 9 aa, Human herpesvirus 4
SRVHGNGTL

SEQ ID NO: 203 - protein, 9 aa, Human herpesvirus 4
ETFTETWNR

SEQ ID NO: 204 - protein, 15 aa, Human herpesvirus 4
AGLTLSLLVICSYLF

SEQ ID NO: 205 - protein, 15 aa, Human herpesvirus 4
VKLTMEYDDKVSKSH

SEQ ID NO: 206 - protein, 15 aa, Human herpesvirus 4
ERPLAVQLARKRTSS

SEQ ID NO: 207 - protein, 13 aa, Human herpesvirus 4
TVVLRYHVLLEEI

SEQ ID NO: 208 - protein, 15 aa, Human herpesvirus 4
NSETFTETWNRFITH

SEQ ID NO: 209 - protein, 12 aa, Human herpesvirus 4
PYYVVDLSVRGM

SEQ ID NO: 210 - protein, 19 aa, Human herpesvirus 4
AGLTLSLLVICSYLFISRG

The invention claimed is:

1. A preparation comprising Epstein-Barr virus-like particles (EB-VLPs), said EB-VLPs being essentially free of Epstein Barr virus (EBV) DNA, wherein said EB-VLPs comprise a vaccination polypeptide, said vaccination polypeptide comprising at least one peptide of an EBV tegument polypeptide and at least one immunogenic peptide, wherein said at least one immunogenic peptide is an immunogenic peptide not derived from a tegument polypeptide of EBV, and wherein said at least one immunogenic peptide comprises at least one T-cell epitope.

2. The preparation of claim 1, wherein said at least one immunogenic peptide is an immunogenic peptide of a pathogenic microorganism.

3. The preparation of claim 1, wherein said at least one immunogenic peptide is an immunogenic peptide of a latent EBV polypeptide.

4. The preparation of claim 3, wherein said latent EBV polypeptide is selected from the list consisting of EBNA-1, EBNA-LP, EBNA-2, EBNA-3A, EBNA-3B, EBNA-3C, LMP-1, and LMP-2A.

5. The preparation of claim 1, wherein said EBV tegument polypeptide is the EBV BNRF1 polypeptide.

6. The preparation of claim 5, wherein said immunogenic peptide is inserted into said BNRF1 polypeptide at any one of positions 1 to 172 of the BNRF1 polypeptide of Genbank Accession Number P03179.1 and/or replaces amino acids within said positions.

7. The preparation of claim 1, wherein said vaccination polypeptide comprises the amino acid sequence of SEQ ID NO:1, 2, or 3.

8. A polynucleotide encoding the vaccination polypeptide as specified in claim 1.

9. The polynucleotide of claim 8, wherein said polynucleotide further encodes an EBV genome.

10. A method for stimulating T-cells of a subject comprising contacting said subject with
a preparation according to claim 1,
thereby stimulating T-cells of said subject.

11. The method of claim 10, wherein said method is a method of vaccination of said subject.

12. The preparation of claim 1, wherein said at least one immunogenic peptide is an immunogenic peptide of a virus.

13. The preparation of claim 1, wherein said at least one immunogenic peptide is an immunogenic peptide of a herpes virus.

14. The preparation of claim 3, wherein said latent EBV polypeptide comprises EBNA-1.

15. The preparation of claim 1, wherein said vaccination polypeptide consists of the amino acid sequence of SEQ ID NO:1, 2, or 3.

* * * * *